US011492650B2

(12) United States Patent
Mandell et al.

(10) Patent No.: US 11,492,650 B2
(45) Date of Patent: Nov. 8, 2022

(54) PRODUCTION OF SELENO-BIOLOGICS IN GENOMICALLY RECODED ORGANISMS

(71) Applicants: BOARD OF REGENTS, THE UNIVERSITY OF TEXAS SYSTEM, Austin, TX (US); PRESIDENT AND FELLOWS OF HARVARD COLLEGE, Cambridge, MA (US)

(72) Inventors: Daniel J. Mandell, Brookline, MA (US); Christopher John Gregg, Melrose, MA (US); Ross Thyer, Austin, TX (US); Andrew D. Ellington, Austin, TX (US); Peter Benjamin Stranges, Somerville, MA (US)

(73) Assignees: BOARD OF REGENTS, THE UNIVERSITY OF TEXAS SYSTEM, Austin, TX (US); PRESIDENT AND FELLOWS OF HARVARD COLLEGE, Cambridge, MA (US)

( * ) Notice: Subject to any disclaimer, the term of this patent is extended or adjusted under 35 U.S.C. 154(b) by 379 days.

(21) Appl. No.: 16/329,761

(22) PCT Filed: Aug. 30, 2017

(86) PCT No.: PCT/US2017/049354
§ 371 (c)(1),
(2) Date: Feb. 28, 2019

(87) PCT Pub. No.: WO2018/045018
PCT Pub. Date: Mar. 8, 2018

(65) Prior Publication Data
US 2019/0194713 A1 Jun. 27, 2019

Related U.S. Application Data

(60) Provisional application No. 62/537,986, filed on Jul. 28, 2017, provisional application No. 62/381,316, filed on Aug. 30, 2016.

(51) Int. Cl.
C12P 21/02 (2006.01)
C07K 14/62 (2006.01)
A61K 38/28 (2006.01)
C07K 16/00 (2006.01)
C07K 16/18 (2006.01)
C12N 15/11 (2006.01)
A61K 38/00 (2006.01)

(52) U.S. Cl.
CPC .............. *C12P 21/02* (2013.01); *A61K 38/28* (2013.01); *C07K 14/62* (2013.01); *C07K 16/00* (2013.01); *C07K 16/18* (2013.01); *C12N 15/11* (2013.01); *A61K 38/00* (2013.01); *C07K 2317/94* (2013.01)

(58) Field of Classification Search
CPC .......... C12N 9/22; C12N 15/11; C12N 15/70; C12Q 1/44; G06F 16/24; G16B 30/00; A61K 38/00; A61K 38/28; A61P 3/10; C07K 14/61; C07K 14/62; C07K 16/00; C07K 16/10; C07K 16/16; C07K 16/18; C07K 16/241; C07K 16/243; C07K 16/249; C07K 16/2863; C07K 16/32; C07K 2317/14; C07K 2317/24; C07K 2317/622; C07K 2317/94; C07K 2319/30; C12P 21/02
See application file for complete search history.

(56) References Cited

U.S. PATENT DOCUMENTS

| | | | |
|---|---|---|---|
| 9,181,318 B2 * | 11/2015 | Satoshi | C12Q 1/66 |
| 9,464,288 B2 | 10/2016 | Soll et al. | |
| 10,023,893 B2 | 7/2018 | Soll et al. | |
| 10,240,158 B2 | 3/2019 | Soll et al. | |
| 10,557,160 B2 | 2/2020 | Ellington et al. | |
| 11,155,804 B2 * | 10/2021 | Ellington | C07K 14/245 |
| 2009/0087852 A1 | 4/2009 | Gladyshev et al. | |
| 2009/0155255 A1 | 6/2009 | Glaser et al. | |
| 2010/0240038 A1 * | 9/2010 | Inouye | C07K 14/62 |
| | | | 435/6.14 |
| 2010/0298212 A1 | 11/2010 | Miao et al. | |

(Continued)

FOREIGN PATENT DOCUMENTS

| | | |
|---|---|---|
| WO | WO 01/12657 | 2/2001 |
| WO | WO 2007/075438 | 7/2007 |

(Continued)

OTHER PUBLICATIONS

Arai et al. Preparation of Selenoinsulin as a Long-Lasting Insulin Analogue. Angewandte ChemiE International Edition. vol. 56, No. 20, pp. 5522-5526. (Year: 2017).*

Aldag, Caroline, et al. "Rewiring Translation for Elongation Factor Tu-Dependent Selenocysteine Incorporation." *Angewandte Chemie International Edition* 52.5 (2013): 1441-1445.

Anderson, J. C. et al. An expanded genetic code with a functional quadruplet codon. Proc. Natl. Acad. Sci. U. S. A. 101, 7566-7571 (2004).

(Continued)

*Primary Examiner* — Marcela M Cordero Garcia
(74) *Attorney, Agent, or Firm* — Parker Highlander PLLC

(57) ABSTRACT

Polypeptides that fold into biologies are stabilized by diselenide bonds between selenocysteine amino acids. Methods to produce such polypeptides in genomically recoded organisms (GRO) can be scaled up for industrial production. Since diselenides have the same geometric bond angles and torsions as disulfides, as well as very similar bond lengths, they can be substituted into polypeptides without disrupting the three dimensional structure of the polypeptides. Diselenides render the polypeptides resistant to reduction when they are exposed to blood serum or to reducing components of blood serum or to reducing components components within cells.

10 Claims, 9 Drawing Sheets
Specification includes a Sequence Listing.

(56) References Cited

U.S. PATENT DOCUMENTS

| | | |
|---|---|---|
| 2013/0303406 A1 | 11/2013 | Kim et al. |
| 2014/0154744 A1* | 6/2014 | Soll .......... C07K 14/47 435/69.6 |
| 2014/0303084 A1 | 10/2014 | Thorn et al. |
| 2015/0050682 A1 | 2/2015 | Hondal et al. |
| 2016/0060301 A1 | 3/2016 | Jewett et al. |
| 2016/0115232 A1 | 4/2016 | Kim et al. |
| 2016/0229920 A1 | 8/2016 | Ward et al. |
| 2017/0166945 A1 | 6/2017 | Ellington et al. |
| 2018/0105854 A1 | 4/2018 | Söll et al. |
| 2019/0241640 A1* | 8/2019 | Menting .......... C07K 14/43509 |
| 2019/0316110 A1 | 10/2019 | Ellington et al. |

FOREIGN PATENT DOCUMENTS

| | | |
|---|---|---|
| WO | WO 2009/067636 | 5/2009 |
| WO | WO 2013/009868 | 1/2013 |
| WO | WO 2016/172269 | 10/2016 |
| WO | WO 2018/014091 | 1/2018 |
| WO | WO/2020/214955 | 10/2020 |

OTHER PUBLICATIONS

Arai, Kenta, et al. "Preparation of selenoinsulin as a long-lasting insulin analogue," Angewandte Chemie 129.20 (2017): 5614-5618.

Armishaw et al., Alpha-selenoconotoxins, a new class of potent alpha7 neuronal nicotinic receptor antagonists. J Biol Chem 281, 14136-43 (2006).

Chatterjee, A., Lajoie, M. J., Xiao, H., Church, G. M. & Schultz, P. G. A Bacterial Strain with a Unique Quadruplet Codon Specifying Non-native Amino Acids. Chembiochem, n/a-n/a (2014).

Chatterjee, A., Sun, S. B., Furman, J. L., Xiao, H. & Schultz, P. G. A Versatile Platform for Single- and Multiple-Unnatural Amino Acid Mutagenesis in Escherichia coli. Biochemistry 52, 1828-1837, doi:10.1021/bi4000244 (2013).

Database ENA, Accession No. ENG64632, "Escherichia coli p0305293.4 cysteine synthase A", dated Apr. 10, 2013.

Database ENA, Accession No. KJJ77964, "Escherichia coli glutamyl tRNA reductase", dated May 12, 2016.

Database UniProt, Accession No. B1ITB1, "RecName: Full= Peptide chain release factor 2", dated May 20, 2008.

Database UniProt, Accession No. F4VHX6, "RecName: Full=7-carboxy-7-deazaguanine synthase", dated Jun. 28, 2011.

Database UniProt, Accession No. G5QQB8, "RecName: Full =Aerobic respiration control sensor protein", dated Jan. 25, 2012.

Extended European Search Report and Written Opinion issued in European Application No. 17847457.3, dated Jun. 12, 2020.

Extended European Search Report and Written Opinion issued in European Application No. 17828247.1, dated Jun. 29, 2020.

Ganther et al., Selenium metabolism, selenoproteins and mechanisms of cancer prevention: complexities with thioredoxin reductase. Carcinogenesis 20, 1657-1666 (1999).

International Search Report and Written Opinion issued in International Application No. PCT/US2017/041373, dated Nov. 17, 2017.

International Search Report and Written Opinion issued in International Application No. PCT/US17/49354, dated Jan. 25, 2018.

Invitation to Pay Additional Fees issued in International Application No. PCT/US17/49354, mailed Nov. 17, 2017.

Lajoie, M. J. et al. Probing the limits of genetic recoding in essential genes.Science 342, 361-363, doi:10.1126/science.1241460 (2013).

Lajoie, Marc J., et al. "Genomically recoded organisms expand biological functions." Science 342.6156 (2013): 357-360.

Li, Xiuling, et al. "Site-specific dual antibody conjugation via engineered cysteine and selenocysteine residues." Bioconjugate Chemistry 26.11 (2015): 2243-2248.

Liu, C. C. & Schultz, P. G. Adding new chemistries to the genetic code. An. Rev. Biochem. 79, 413-444 (2010).

Liu, Hongcheng, and Kimberly May. "Disulfide bond structures of IgG molecules: structural variations, chemical modifications and possible impacts to stability and biological function." MAbs. vol. 4. No. 1. Taylor & Francis, 2012.

Mandell, Daniel J., et al. "Biocontainment of genetically modified organisms by synthetic protein design." Nature 518.7537 (2015): 55-60.

McDaniel, Timothy K., et al. "A genetic locus of enterocyte effacement conserved among diverse enterobacterial pathogens," Proceedings of the National Academy of Sciences 92.5 (1995): 1664-1668.

Miller, Corwin, et al. "A synthetic tRNA for EF-Tu mediated selenocysteine incorporation in vivo and in vitro." FEBS letters5i9A.T (2015): 2194-2199.

Moroder, Luis, et al. "Synthesis of single-and multiple-stranded cystine-rich peptides." Peptide Science: Original Research on Biomolecules 80.2-3 (2005): 85-97.

Mueller, Sabine, et al. "The formation of diselenide bridges in proteins by incorporation of selenocysteine residues: biosynthesis and characterization of (Se) 2-thioredoxin." Biochemistry 33.11 (1994): 3404-3412.

Muttenthaler et al., Modulating oxytocin activity and plasma stability by disulfide bond engineering. J Med Chem 53, 8585-96 (2010).

Neumann, H., Wang, K., Davis, L., Garcia-Alai, M. & Chin, J. W. Encoding multiple unnatural amino acids via evolution of a quadruplet-decoding ribosome. Nature 464, 441-444, (2010).

Neumann, H., Wang, K., Davis, L., Garcia-Alai, M. & Chin, J. W. Encoding multiple unnatural amino acids via evolution of a quadruplet-decoding ribosome. Nature 464, 441-444, (2010). Supplemental Information.

Ostrov, Nili, et al. "Design, synthesis, and testing toward a 57-codon genome." Science 353.6301 (2016): 819-822.

Partial European Search Report and Written Opinion issued in European Application No. 17847457.3, dated Mar. 12, 2020.

Partial European Search Report and Written Opinion issued in European Application No. 17828247.1, dated Jan. 31, 2020.

Rengby, Olle, and Elias SJ Arnér. "Titration and conditional knockdown of the prfB gene in Escherichia coli: effects on growth and overproduction of the recombinant mammalian selenoprotein thioredoxin reductase." Applied and Environmental Microbiology 73.2 (2007): 432-441.

Safavi-Hemami, Helena, et al. "Specialized insulin is used for chemical warfare by fish-hunting cone snails." Proceedings of the National Academy of Sciences 112.6 (2015): 1743-1748.

SCORE result for US 2014-0154744, SEQ ID No. 18, dated 2014. Downloaded from internet on Oct. 31, 2018, U.S. Appl. No. 15/380,560.

SCORE result for WO 2013/009868, dated 2013. Downloaded from internet on Jun. 3, 2019, U.S. Appl. No. 15/380,560.

Thyer, Ross, et al. "Evolving tRNASec for efficient canonical incorporation of selenocysteine." Journal of the American Chemical Society 137.1 (2015): 46-49.

Thyer, Ross, et al. "Custom selenoprotein production enabled by laboratory evolution of recoded bacterial strains." Nature biotechnology 36.7 (2018): 624-631.

Wang, Fei, Jana M. Carabino, and Cunegundo M. Vergara. "Insulin glargine: a systematic review of a long-acting insulin analogue." Clinical Therapeutics 25.6 (2003): 1541-1577.

Wang, L., Brock, A., Herberich, B. & Schultz, P. G. Expanding the genetic code of Escherichia coli. Science 292, 498-500 (2001).

Weil-Ktorza, Orit, et al. "Substitution of an internal disulfide bridge with a Diselenide enhances both Foldability and stability of human insulin." Chemistry—A European Journal 25.36 (2019): 8430-8430.

Young, T. S., Ahmad, I., Yin, J. A. & Schultz, P. G. An enhanced system for unnatural amino acid mutagenesis in E. coli. Journal of Molecular Biology 395, 361-374 (2009).

Betz, Stephen F. "Disulfide bonds and the stability of globular proteins." Protein Science 2.10 (1993): 1551-1558.

Dhayalan, Balamurugan, et al. "Reassessment of an innovative insulin analogue excludes protracted action yet highlights distinction between external and internal diselenide bridges." Chemistry (Weinheim an der Bergstrasse, Germany) 26.21 (2020): 4695.

Johnson, Christopher M., et al., "Thermodynamics of denaturation of mutants of barnase with disulfide crosslinks," Journal of Molecular Biology 268.1 (1997): 198-208.

(56) References Cited

OTHER PUBLICATIONS

Kjeldsen, Thomas B., et al. "Molecular Engineering of Insulin Icodec, the First Acylated Insulin Analog for Once-Weekly Administration in Humans." *Journal of Medicinal Chemistry* (2021).

Kuhlman, Brian, and Philip Bradley. "Advances in protein structure prediction and design." *Nature Reviews Molecular Cell Biology* 20.11 (2019): 681-697.

Pandyarajan, Vijay, et al. "Contribution of TyrB26 to the function and stability of insulin: structure-activity relationships at a conserved hormone-receptor interface." *Journal of Biological Chemistry* 291.25 (2016): 12978-12990.

Sciacca, L., et al. "Insulin analogues differently activate insulin receptor isoforms and post-receptor signalling." *Diabetologia* 53.8 (2010): 1743-1753.

Tidor, Brace, and Martin Karplus. "The contribution of cross-links to protein stability: A normal mode analysis of the configurational entropy of the native state." *Proteins: Structure, Function, and Bioinformatics* 15.1 (1993): 71-79.

Takei et al., "Oxidative Folding of Selenocysteine Substituted Insulin Via Interchain Diselenide Bond Formation" 52nd Japanese Peptide Symposium Lecture abstracts, 2015, vol. 52, p. 78, No. P-021.

Office Communication issued in corresponding Japanese Application No. 2019-531589, dated Jan. 7, 2022.

\* cited by examiner

| Bond | Geometry | Covalent radius (Å) | Bond length (Å) | Redox potential (mv) |
|---|---|---|---|---|
| Disulfide | | 1.02 | 2.03 | -220 |
| Diselenide | | 1.17 | 2.33 | -380 |

X-ray crystallography shows disulfides (yellow) and diselenides (red) are isosteric The redox potential of cytoplasm is -280 to -300 mV. Only diselenides can form and maintain in the cytosol Muttenthaler et al, JACS, 2010

PRODUCTION OF SELENO-BIOLOGICS IN GENOMICALLY RECODED ORGANISMS

This application is a national phase application under 35 U.S.C. § 371 of International Application No. PCT/US2017/049354, filed Aug. 30, 2017, which claims the benefit of United States Provisional Patent Application Nos. 62/381,316, filed Aug. 30, 2016, and 62/537,986, filed Jul. 28, 2017, the entirety of which are incorporated herein by reference.

This invention was made with government support under Grant no. FA9550-10-1-0169 awarded by Office of Naval Research and Grant no. N66001-14-2-4051 awarded by the Space and Naval Warfare Systems Center, Pacific. The government has certain rights in the invention.

The sequence listing that is contained in the file named "UTSBP1174US.txt", which is 3.4 MB (as measured in Microsoft Windows) and was created on Jul. 16, 2021, is filed herewith by electronic submission and is incorporated by reference herein.

TECHNICAL FIELD OF THE INVENTION

This invention is related to the area of protein biologics. In particular, it relates to methods to make protein biologics with beneficial properties.

BACKGROUND OF THE INVENTION

Protein biologics, which include monoclonal antibodies, protein therapeutics and vaccines, are effective therapies for cancer, infection, and immunological and other diseases, comprising a multi-billion dollar market. But most biologics must be made in expensive mammalian cell systems in large part because they are stabilized by chemical bonds—called disulfides—that cannot form in microbial cells. Further, because disulfide bonds are prone to chemical reduction, they can break in environments like blood serum and inside cells, so that many biologics have poor half-lives.

The vast majority of biologics—including 98% of therapeutic monoclonal antibodies—are produced in mammalian systems like Chinese hamster ovary (CHO) cells. CHO cells have the advantage of producing human-like glycosylation, and possess the necessary folding chaperones and redox machinery to produce disulfide-bearing proteins at high yield. However, CHO cells require substantially higher capital expenditures than microbial facilities, longer production times (weeks to months vs. days), many-fold higher consumables cost (e.g., media), and additional purification steps to remove endogenous retrovirus-like particles.

There are two existing approaches to producing disulfide-bearing biologics in bacteria. The first is to change the chemical environment inside the cell to become oxidizing and permissive to disulfide formation, but this change dramatically impacts central metabolism and may impair fermentation performance as well as protein production. The second approach is to secrete the nascent biologic to a smaller oxidizing compartment called the periplasm. This approach produces poor yields due to energetic losses during export, and also is highly susceptible to product loss through aggregation. Due to these shortcomings, neither approach has gained widespread adoption for large-scale production of disulfide-bearing biologics, so that more expensive mammalian bio-processes dominate. Importantly, neither approach solves the intrinsic problem that disulfide bonds are sensitive to reducing agents in environments like the cytoplasm or blood.

There is a continuing need in the art for methods of producing protein biologics in a cost effective way. There is a continuing need in the art for method of producing protein biologics that are stable in blood and cytoplasm.

SUMMARY OF THE INVENTION

According to one aspect of the invention a protein is provided which comprises at least two selenocysteine residues with at least one diselenide bond between the at least two selenocysteine residues. The protein comprises a sequence selected from the group consisting of: SEQ ID NO: 1-1632 and sequences that are at least 80% identical to said sequence. The protein may comprise a sequence selected from the group consisting of: SEQ ID NO: 1-1630 and sequences that are at least 80% identical to said sequence. The protein may comprise a sequence selected from the group consisting of: SEQ ID NO: 1631-1632 and sequences that are at least 80% identical to said sequence.

According to another aspect of the invention an antibody molecule is provided which comprises (i) a heavy chain sequence selected from the group consisting of SEQ ID NO: 472-801 and sequences that are at least 80% identical to said sequence; and (ii) a light chain sequence selected from the group consisting of SEQ ID NO: 812-1131 and sequences that are at least 80% identical to said sequence. From 0-15 pairs of selenocysteine residues in the antibody molecule are replaced with from 0-15 pairs of cysteine residues. The antibody may contain at least one diselenide bond between the heavy chain and the light chain. The antibody may contain at least one intra-chain diselenide bond within the heavy chain and/or within the light chain.

According to yet another aspect of the invention a modified insulin protein is provided. It comprises (i) an A chain having a sequence selected from SEQ ID NO: 1142, 1144, 1146, 1148, 1150, 1152, and 1154 and sequences that are at least 80% identical to said sequence; and (ii) a B chain having a sequence selected from SEQ ID NO: 1143, 1145, 1147, 1149, 1151, 1153, and 1155 and sequences that are at least 80% identical to said sequence. The protein comprises at least one diselenide bond between the A chain and the B chain.

According to one aspect of the invention a bacterial host is provided that has been genomically recoded so that an unassigned codon is recognized by a selenocysteine tRNA with a corresponding anticodon. The bacterial host contains a constructed DNA sequence encoding a variant form of a protein in which a pair of cysteine codons has been replaced with the unassigned codon. The variant form comprises a sequence selected from the group consisting of SEQ ID NO: 1-1632 and sequences that are at least 80% identical to said sequence. The variant form may comprise a sequence selected from the group consisting of SEQ ID NO: 1-1630 and sequences that are at least 80% identical to said sequence. The variant form may comprise a sequence selected from the group consisting of SEQ ID NO: 1631-1632 and sequences that are at least 80% identical to said sequence.

According to another aspect of the invention a bacterial host is provided. The bacterial host has been genomically recoded so that an unassigned codon is recognized by a selenocysteine tRNA with a corresponding anticodon. The bacterial host contains a constructed DNA sequence encoding a variant form of a monoclonal antibody in which a pair of cysteine codons has been replaced with the unassigned codon. The monoclonal antibody comprises a VL chain, and positions 23 and 88 of the VL chain are substituted with selenocysteine residues. The monoclonal antibody comprises a VH chain, and positions 22 and 92 of the VH chain are substituted with selenocysteine residues.

According to yet another aspect of the invention a method of producing a variant form of a protein is provided. The protein has a disulfide bond between cysteine residues, and the variant form has a diselenide bond between selenocysteine residues. A bacterial host that has been genomically recoded so that an unassigned codon is recognized by a selenocysteine tRNA with a corresponding anticodon is cultured. The bacterial host contains a constructed DNA sequence encoding the variant form of the protein in which a pair of cysteine codons has been replaced with the unassigned codon. The culturing is performed under conditions in which the variant form of the protein is expressed. The variant form comprises a sequence selected from the group consisting of SEQ ID NO: 1-1632 and sequences that are at least 80% identical to said sequence. The variant form may comprise a sequence selected from the group consisting of SEQ ID NO: 1-1630 and sequences that are at least 80% identical to said sequence. The variant form may comprise a sequence selected from the group consisting of SEQ ID NO: 1631-1632 and sequences that are at least 80% identical to said sequence.

According to one aspect of the invention a method of producing a variant form of a monoclonal antibody is provided. The monoclonal antibody has a disulfide bond between cysteine residues, and the variant form has a diselenide bond between selenocysteine residues. A bacterial host that has been genomically recoded so that an unassigned codon is recognized by a selenocysteine tRNA with a corresponding anticodon is cultured. The bacterial host contains a constructed DNA sequence encoding the variant form of the monoclonal antibody in which a pair of cysteine codons has been replaced with the unassigned codon. The culturing is performed under conditions in which the variant form of the monoclonal antibody is expressed. The monoclonal antibody comprises a VL chain, and positions 23 and 88 of the VL chain are substituted with selenocysteine residues. The monoclonal antibody comprises a VH chain and positions 22 and 92 of the VH chain are substituted with selenocysteine residues.

According to another aspect of the invention a method of treating a mammal with a variant form of a protein is provided. The variant form of the protein is administered to the mammal. The protein has a disulfide bond between cysteine residues. The variant form has a diselenide bond between selenocysteine residues in place of the disulfide bond between cysteine residues. The variant form comprises a sequence selected from the group consisting of SEQ ID NO: 1-1632 and sequences that are at least 80% identical to said sequence. The variant form may comprise a sequence selected from the group consisting of SEQ ID NO: 1-1630 and sequences that are at least 80% identical to said sequence. The variant form may comprise a sequence selected from the group consisting of SEQ ID NO: 1631-1632 and sequences that are at least 80% identical to said sequence.

According to yet another aspect of the invention a method is provided of treating a mammal with a variant form of a monoclonal antibody. The variant form of the monoclonal antibody is administered to the mammal. The monoclonal antibody has a disulfide bond between cysteine residues, wherein the variant form has a diselenide bond between selenocysteine residues in place of the disulfide bond between cysteine residues. The monoclonal antibody comprises a VL chain, and positions 23 and 88 of the VL chain are substituted with selenocysteine residues. The monoclonal antibody comprises a VH chain and positions 22 and 92 of the VH chain are substituted with selenocysteine residues.

According to one aspect of the invention an in vitro translation system comprising a constructed nucleic acid molecule and a tRNA molecule are provided. The constructed nucleic acid molecule encodes a variant form of a protein in which a pair of cysteine residues has been replaced with a pair of selenocysteine residues. The variant form comprises a sequence selected from the group consisting of SEQ ID NO: 1-1632 and sequences that are at least 80% identical to said sequence. The variant form may comprise a sequence selected from the group consisting of SEQ ID NO: 1-1630 and sequences that are at least 80% identical to said sequence. The variant form may comprise a sequence selected from the group consisting of SEQ ID NO: 1631-1632 and sequences that are at least 80% identical to said sequence. The nucleic acid molecule comprises an unassigned codon or leverages suppression of cognate codons to incorporate selenocysteine(s) into a growing polypeptide. The tRNA molecule is a selenocysteine tRNA with an anticodon that corresponds to the unassigned codon.

According to another aspect of the invention an in vitro translation system comprising a constructed nucleic acid molecule and a tRNA molecule is provided. The constructed nucleic acid molecule encodes a variant form of a monoclonal antibody which comprises a VL chain. Positions 23 and 88 of the VL chain are substituted with selenocysteine residues. The monoclonal antibody comprises a VH chain, and positions 22 and 92 of the VH chain are substituted with selenocysteine residues. The constructed nucleic acid molecule comprises at least a pair of cysteine codons that has been replaced with an unassigned codon in the nucleic acid. The tRNA molecule is a selenocysteine tRNA with an anticodon that is complementary to the unassigned codon.

According to yet another aspect of the invention a method is provided for producing a variant form of a protein. The protein has a disulfide bond between cysteine residues, wherein the variant form has a diselenide bond between selenocysteine residues. A constructed nucleic acid sequence encoding the variant form of the protein is translated. The constructed nucleic acid sequence comprises a pair of cysteine codons that has been replaced with an unassigned codon. The variant form comprises a sequence selected from the group consisting of SEQ ID NO: 1-1632 and sequences that are at least 80% identical to said sequence. The variant form may comprise a sequence selected from the group consisting of SEQ ID NO: 1-1630 and sequences that are at least 80% identical to said sequence. The variant form may comprise a sequence selected from the group consisting of SEQ ID NO: 1631-1632 and sequences that are at least 80% identical to said sequence. The step of translating employs a selenocysteine tRNA with a corresponding anticodon to the unassigned codon.

According to one aspect of the invention a method of testing a sample is provided. A sample is contacted with a variant form of a protein to form a reaction mixture. The protein has a disulfide bond between cysteine residues. The variant form has a diselenide bond between selenocysteine residues in place of the disulfide bond between cysteine residues. The variant form comprises a sequence selected from the group consisting of SEQ ID NO: 1-1632 and sequences that are at least 80% identical to said sequence. The variant form may comprise a sequence selected from the group consisting of SEQ ID NO: 1-1630 and sequences that are at least 80% identical to said sequence. The variant form may comprise a sequence selected from the group consisting of SEQ ID NO: 1631-1632 and sequences that are at least 80% identical to said sequence. The reaction mixture is tested to detect a specific binding partner bound to the variant form of the protein.

According to another aspect of the invention a method is provided for testing a sample. A sample is contacted with a variant form of a monoclonal antibody to form a reaction mixture. The monoclonal antibody has a disulfide bond between cysteine residues. The variant form has a diselenide bond between selenocysteine residues in place of the disulfide bond between cysteine residues. The monoclonal antibody comprises a VL chain, and positions 23 and 88 of the VL chain are substituted with selenocysteine residues. The monoclonal antibody comprises a VH chain and positions 22 and 92 of the VH chain are substituted with selenocysteine residues. The reaction mixture is tested to detect a specific binding partner bound to the variant form of the protein.

According to yet another aspect of the invention a modified antibody is provided. It comprises at least one diselenide bond.

According to one aspect of the invention a modified insulin protein is provided. It comprises an A chain having residues 90-110 of SEQ ID NO: 1630 with at least one cysteine to selenocysteine substitution; a B chain having residues 25-54 of SEQ ID NO: 1630 with at least one cysteine to selenocysteine substitution; and at least one diselenide bridge between the A chain and the B chain.

Another aspect of the invention is a modified human insulin protein comprising at least two selenocysteine residues replacing two cysteine residues in a native human insulin protein. It has at least one diselenide bond between the at least two selenocysteine residues.

These and other aspects which will be apparent to those of skill in the art upon reading the specification provide the art with methods and products for treating human and animal diseases and for making and using therapeutic, diagnostic, analytical, and prophylactic agents.

BRIEF DESCRIPTION OF THE DRAWINGS

FIG. 1 shows a comparison of properties of diselenide and disulfide bonds.

FIG. 3A-3B shows zoomed-in deconvoluted mass spectrum (FIG. 3A) and fragmentation sequence map (FIG. 3B) of 10 µM anti-MS2 scFv. Fragmentation spectra were deconvoluted using Xtract with a S/N threshold of 3 and analyzed using ProSight Lite. Formation of diselenide bonds is indicated by the lack of fragment ions between the marked selenocysteine (U) residues. No mass peaks corresponding to serine incorporation were detected. The sequence shown in FIG. 3B corresponds to SEQ ID NO: 1632.

DETAILED DESCRIPTION OF THE INVENTION

A sequence listing forms part of the disclosure of this application and is incorporated as part of the disclosure.

Figure 2:
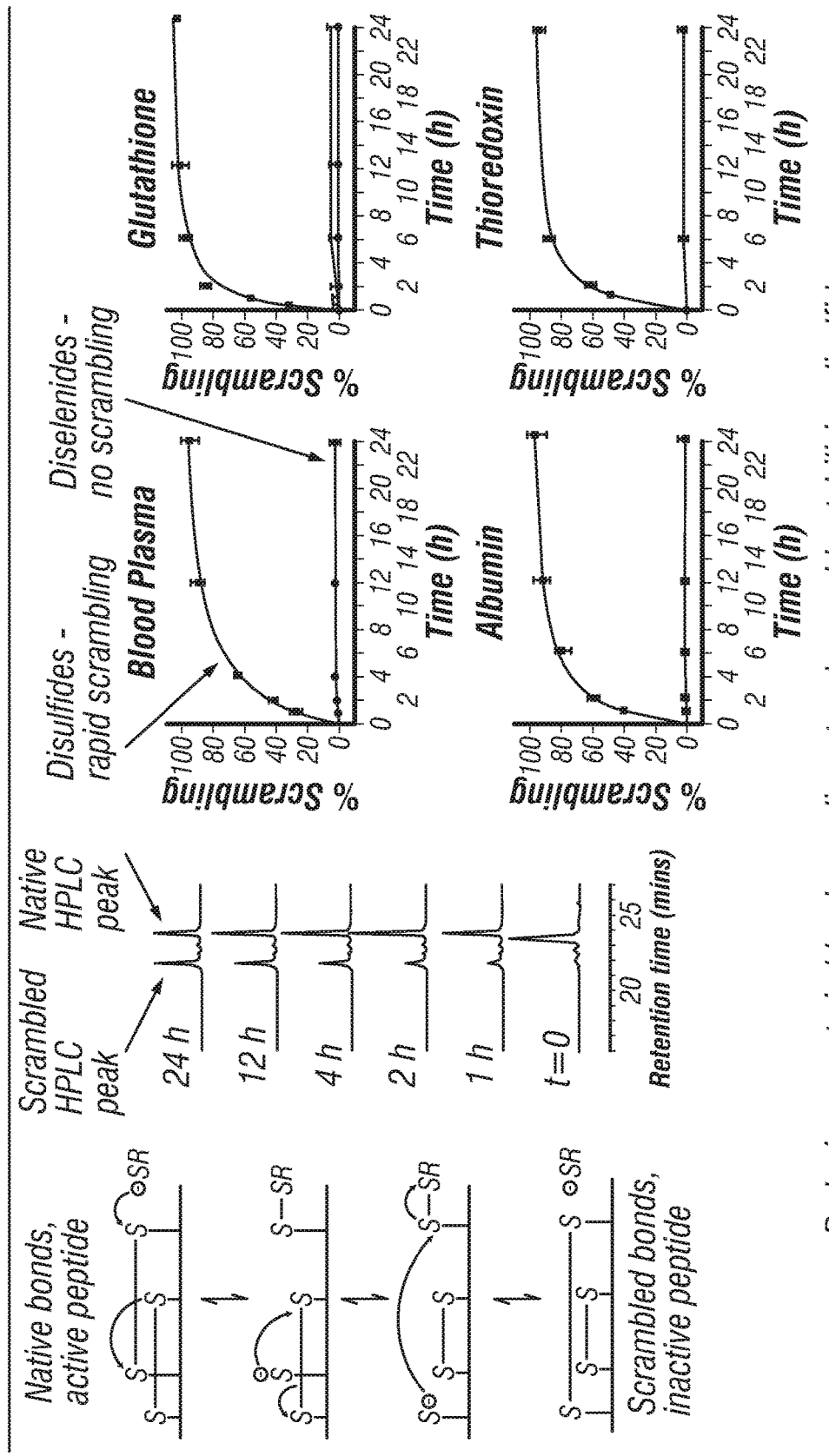
FIG. 2 shows that diselenide biologics show dramatic improvements to serum half-life over disulfides.

The inventors have developed polypeptides and methods to produce polypeptides in genomically recoded organisms (GRO) that fold into biologics that are stabilized by diselenide bonds between selenocysteine amino acids. Whereas disulfide bonds between cysteine amino acids have a redox potential of about −220 mV, diselenide bonds have a redox potential of about −380 mV. Since the bacterial cytosol typically has a redox potential of about −280 to −300 mV, diselenides but not disulfides avoid reduction so that they form and persist in the cytosol. Since diselenides have the same geometric bond angles and torsions as disulfides, as well as very similar bond lengths, they can be substituted into polypeptides without disrupting the three dimensional structure of the polypeptide (FIG. 1). Further, since intended in vivo environments like blood contain reducing agents like glutathione, albumin, and thioredoxin, disulfides in polypeptides can be reduced, causing the polypeptide to unfold and, in the case of multiple disulfides, "scramble" the disulfides so that incorrect cysteines are bonded to each other. Both of these result in abrogation of the intended biological activity of the polypeptide. The lower redox potential of diselenides renders them resistant to reduction when exposed to blood serum or purified reducing components of blood serum (FIG. 2), endowing them with a longer blood serum half-life than disulfide-bearing counterparts (Muttenhaler et al.).

While peptides bearing diselenide-forming selenocysteines may be produced in vitro by solid phase peptide synthesis (Armishaw et al., Safavi-Hemami et al.), the process does not scale tractably to the yields necessary for therapeutic applications, particularly for proteins. However, in vivo production of recombinant seleno-proteins is limited by strict sequence requirements on where selenocysteine may appear in proteins. In particular, a selenocysteine insertion sequence (SECIS) element must appear in the coding DNA sequence at the selenocysteine incorporation site in order to recruit endogenous selenocysteine translation machinery, composed of specialized enzymes (selA, selD), tRNA (selC), and an elongation factor (selB). Instead, we use a recoded strain of E. coli, which has an unassigned codon, such as an amber stop codon, together with an engineered selenocysteine tRNA with an anti-amber anticodon that permits targeted placement of selenocysteine into polypeptides by introduction of the amber stop codon into the corresponding DNA coding sequence. Typically, recoding entails removing all naturally occurring instances of the unassigned codon from the genome, as well as removing or otherwise deactivating the translational machinery associated with the unassigned codon (e.g., for amber, removing or deactivating Release Factor 1). The modified tRNA interacts with the endogenous elongation factor EF-Tu. Other codons can be recoded, typically rare codons, as is known in the art. See, Ostrov et al., Science, 353:819-822, 2016. A codon on an mRNA and an anti-codon on a tRNA are typically triplets of complementary base sequences.

Recoded proteins may be synthesized in bacteria, such as E. coli cells, or in vitro, in translation or linked transcription-translation systems. Genes or mRNA encoding such recoded proteins are non-naturally occurring, and are variants of naturally occurring coding sequences.

Although many of the proteins that we show in the associated sequence listing have all cysteine residues which participate in disulfide bonds replaced with selenocysteine residues, all cysteine residues need not be replaced to gain the benefits of the substitution. Even one diselenide bond may improve the stability of a protein. Any number of diselenide bonds (selenocysteine pairs) may be substituted for disulfide bonds in the proteins. If a protein has N disulfide bonds, the protein may have anywhere from N, N minus 1, N minus 2, N minus 3, N minus 4, . . . down to 1 such bond. Proteins with different combinations of diselenide bonds and disulfides are shown in SEQ ID NO: 1220 to 1632. It is also possible to form a bond between cysteine and selenocysteine residues called a selenylsulfide. This bond has a lower redox potential (~270 my) than a disulfide (−220 my) but not than bacterial cytoplasm (−280 my). The selenylsulfide bond may be used to increase resistance to reduction in certain redox environments. Selenylsulfides may be used in place of diselenides using methods described here by substituting selenocysteine for a single disulfide bonded cysteine, or by substituting cysteine for a single diselenide bonded selenocysteine.

Figure 3A:
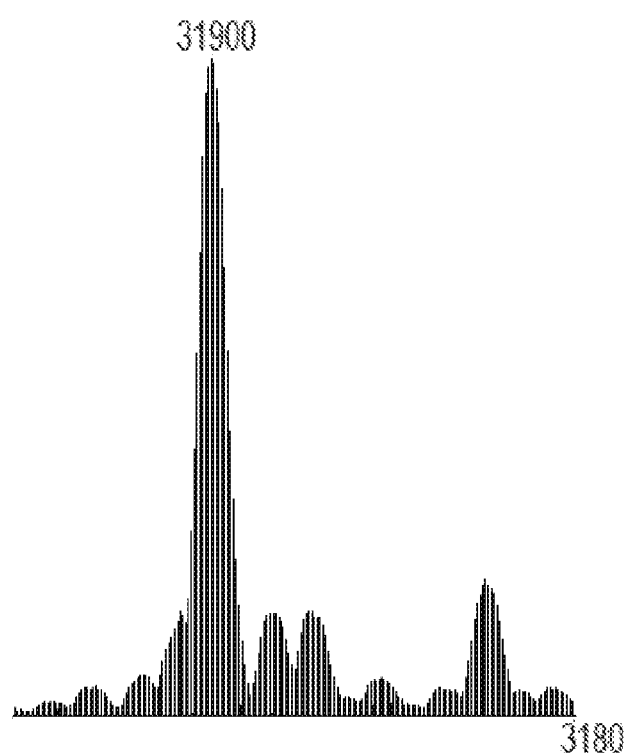

Sequences of disulfide-stabilized biologics with substituted selenocysteines can be produced in the cytosol of E. coli using our method at the mg/L scale in standard laboratory shaker flasks, and scaled to g/L production in microbial fermenters. These sequences include therapeutic proteins, vaccines, and monoclonal antibodies, antibody fragments, antibody conjugates, and other immunoglobulin-like molecules. The Fv domains may be combined with any human Fc domains. Further, any Fv domain may be produced in our system by substituting selenocysteine for cysteine at positions 23 and 88 using Kabat numbering in the variable light chain and/or by substituting selenocysteine for cysteine at positions 22 and 92 using Kabat numbering in the variable heavy chain Immunoglobulin classes IgG, IgA, IgM, IgD and IgE (including IgA1, IgA2, IgG1, IgG2, IgG3, and IgG4 subclasses) may be produced by these methods as typified classes, with any constant variant therein combined with either the Ig kappa or lambda constant light chain variants known to those in the art. Any selenocysteine in the disclosed sequences may be maintained as a cysteine so long as the presence of the cysteine does not interfere with the expression, folding, or intended function of the polypeptide. We disclose methods below for producing and verifying the presence of selenocysteines participating in the intended diselenide bonds for antibody single chain variable fragments (scFv, FIGS. 3, 6), human growth hormone (hGH, FIG. 6), PD-L1 (FIG. 4), variants of human Fc (FIG. 4), and fusions of PD-L1 and hGH to variants of human Fc (FIGS. 4 and 5), but these methods also apply to full monoclonal antibodies, other antibody fragments, antibody conjugates, other therapeutic proteins, and vaccines.

Therapeutic, diagnostic, biosensing, and prophylactic biologics may be made and used according to the invention with diselenide bonds between two selenocysteine residues. This technique and modification may be useful for any protein biologic, including but not limited to hormones (e.g., human growth hormone, FIG. 8), antibodies and antibody fragments (FIGS. 7 and 8), cytokines, growth factors, structural proteins, and the like. Insulin products, such as Lantus™, Novorapid™ Humalog™, Humulin™, Levemir™, Apidra™, and Tresiba™ may be useful with such modifications, as shown in SEQ ID NO: 1142-1155. The A chains of these insulin products can be modified as shown in SEQ ID NO: 1142, 1144, 1146, 1148, 1150, 1152, and 1154. The B chains of these insulin products can be modified as shown in SEQ ID NO: 1143, 1145, 1147, 1149, 1151, 1153, and 1155. The diselenide bonds may be intramolecular or intermolecular. Additional proteins that are suitable for such modifications include Programmed death-ligand 1 (PD-L1), PD-L1 fusion protein to an antibody domain(s), portions of PD-L1, such as the binding domain whether fused or unfused to an antibody domain(s), antibody domain(s), human growth hormone whether fused or unfused to an antibody domain(s), and Herceptin (FIGS. 4-8). This is not intended to be an exhaustive list of proteins that can be so modified.

Although particular exemplary proteins are shown with a particular sequence in the sequence listing, which forms part of this disclosure, these sequences need not be used and reproduced with total fidelity. As is known in the art, slight modifications to proteins including allelic variations and polymorphisms may occur in parts of proteins that are not detrimental to their use and function. Thus useful proteins according to the present invention may have the precise sequences which are shown in the sequence listing or they may be slightly different. For example, useful proteins may be at least 99 percent, at least 98 percent, at least 97 percent, at least 96 percent, at least 95 percent, at least 94 percent, at least 93 percent, at least 92 percent, at least 91 percent, at least 90 percent, at least 89 percent, at least 88 percent, at least 87 percent, at least 86 percent, at least 85 percent, at least 84 percent, at least 83 percent, at least 82 percent, 81 percent, or at least 80 percent identical.

The proteins that can be made according to the invention are unlimited in purpose. They can be therapeutic proteins, prophylactic proteins (such as vaccines), enzymatic proteins, endocrine proteins, signaling proteins, scaffolding proteins, diagnostic proteins, analytic proteins, etc. The diselenide bonds will generally make the proteins more stable in the presence of reducing agents.

The proteins can be made in a host cell, or in vitro, in cell-free synthetic systems. Host cells may be any that can be robustly recoded. These can be bacterial cells that have well developed genetic systems, of which E. coli is exemplary. Other bacterial species can also be used. Cell-free systems for producing the proteins may be coupled transcription/translation systems or only translation systems. A notable aspect of the methods of the invention is the use of biological syntheses rather than chemical synthesis means.

Culturing of recoded cells with the constructed nucleic acid sequences may be by any means known in the art. The culturing may be batch or continuous, in shaker flasks or in fermenters or immobilized on solid surfaces, such as small particles contained in larger vessels. Typically the culture medium will be supplemented with a source of selenium, such as $Na_2SeO_3$. As is known in the art, production of the desired protein variant may be under the control of an inducer or a repressor. Any such systems that are known in the art may be selected for convenience of construction and protein production.

Administration of a therapeutic, diagnostic, or prophylactic protein to a subject in need of such treatment may be by any means known in the art and suitable for the protein. These include without limitation intravenous, intramuscular, subcutaneous, intrathecal, oral, intracoronary, and intracranial deliveries. Certain proteins are appropriate for certain types of delivery, due to stability and target. Administration of a therapeutic protein can include one or more pharmaceutically acceptable carriers, such as, for example, a liquid or solid filler, diluent, excipient, buffer, stabilizer, or encapsulating material.

The above disclosure generally describes the present invention. All references disclosed herein are expressly incorporated by reference. A more complete understanding can be obtained by reference to the following specific examples which are provided herein for purposes of illustration only, and are not intended to limit the scope of the invention.

Example 1 scFv Expression and Purification

RTAA 2X310K cells transformed with plasmid pACYC-PcaU-aMS2 bearing a gene encoding an anti-alpha MS2 scFv antibody with UAG codons directing selenocysteine incorporation substituted in place of all cysteine codons were diluted 1/250 in 1 L of terrific broth supplemented with 1000 µg·mL carbenicillin, 12.5 µg mL tetracycline and 25 µM $Na_2SeO_3$ and induced with (1 mM) 3,4-dihydroxybenzoic acid during mid log phase followed by growth O/N at 37° C. Cells were harvested by centrifugation at 8000×g for 10 min and resuspended in 25 mL of wash buffer (50 mM $K_2HPO_4$, 300 mM NaCl, 20 mM imidazole and 10% glycerol at pH 8.0) with protease inhibitor cocktail (cOmplete, mini EDTA free, Roche) and lysozyme (0.5 mg·mL$^{-1}$). Following a 20 min incubation at 4° C. with gentle agitation cells were lysed by sonication (Model 500, Fisher Scientific) and clarified three times by centrifugation at 35000×g for 30 min. Lysate was filtered through a 0.2 µm membrane and protein was recovered by IMAC using Ni-NTA resin and gravity flow columns Eluate was concentrated to 3 mL and dialyzed against TBS pH 7.5 followed by purification to apparent homogeneity by size exclusion FPLC. A significant proportion of the sample precipitated during dialysis and an additional proportion of the sample was present in the less stable/soluble dimer form. Final yield of soluble aMS2 seleno-scFv monomer was 3 mg/L.

RTΔA 2X310K-T7 cells transformed with plasmid pACYC-TetO-aTNF bearing a gene encoding an anti-TNF (tumor necrosis factor) scFv antibody with UAG codons directing selenocysteine incorporation substituted in place of all cysteine codons were diluted 1/250 in 1 L of terrific broth supplemented with 1000 µg mL carbenicillin, 33 µg·mL chloramphenicol and 25 µM $Na_2SeO_3$ and induced with 200 ng·mL anhydrotetracycline during mid log phase followed by growth O/N at 30° C. Cell were harvested and purified by IMAC as previously described. To reduce precipitation, samples were dialysed in larger volumes (>6 mL). Protein samples were purified to homogeneity by either size exclusion FPLC or anion exchange chromatography (HiTrap Q HP column) Anti-RCA, anti-GM-CSF, and anti-interferon gamma seleno-scFvs were purified by the same procedure. Final yield of soluble seleno-scFv monomers ranged between 0.5-1 mg/L.

Example 2

Mass Spectrometry

Intact protein samples were analyzed using methods described previously. Selenoprotein samples were buffer exchanged into LC-MS grade water using 10 kDa molecular weight cut-off filters. Once the buffer exchange was complete the samples were diluted to 20 µM in a methanol/water/formic acid (50/49/1) solution. After dilution, protein solutions were infused into an Orbitrap Elite mass spectrometer (Thermo Fisher Scientific Instruments, Bremen, Germany) at a rate of 3 µL·min$^{-1}$ via electrospray ionization. In order to confirm the incorporation of selenocysteine, intact mass analysis was carried out at 240 k resolution and averaging 20 scans. Characterization of the protein sequences was undertaken by ultraviolet photodissociation (UVPD) using a 193 nm excimer laser (Coherent, Inc.) which was interfaced to the Orbitrap mass spectrometer as described previously. For each UVPD spectrum, two laser pulses of 2.5 mJ were used and 250 scans were averaged. MS1 spectra were deconvoluted using the Xtract deconvolution algorithm (Thermo Fisher Scientific). UVPD mass spectra were also deconvoluted using Xtract and then analyzed using ProsightPC 3.0. Proteins containing selenocysteine were searched by adding a modification of 61.9146 Da to serine residues at the four incorporation sites (including the subtraction of one hydrogen atom due to formation of diselenide bonds). Incorporation efficiencies were calculated by dividing the area of the modified protein peak by the summed areas of the unmodified protein peak and the modified protein peak. The peak area used for each protein was the sum of the integrated areas of the five most abundant peaks from each isotope cluster.

Example 3

UAG Genomically Recoded Organism Suitable for Expressing Polypeptides with Non-Standard Amino Acids A Genomically Recoded Organism (GRO) in which the UAG codon translational function is completely removed is used to unambiguously incorporate non-standard amino acids (NSAAs) at UAG. See Lajoie, M. J. et al. Genomically recoded organisms expand biological functions. Science 342, 357-360, doi:10.1126/science.1241459 (2013), incorporated by reference in its entirety. A genomically recoded organism may include one or more reassigned triplet codons to facilitate the incorporation of non-standard amino acids (NSAAa), such as selenocysteine. Triplet codons can be reassigned to incorporate non-standard amino acids, such as selenocysteine, using methods known to those of skill in then art. See Lajoie, M. J. et al. Probing the limits of genetic recoding in essential genes. Science 342, 361-363, doi: 10.1126/science.1241460 (2013), incorporated by reference in its entirety. See also Thyer, R. et al. Evolving tRNA$^{Sec}$ for Efficient Canonical Incorporation of Selenocysteine. JACS 137(1), 46-49, (2015), incorporated by reference in its entirety. See also Ostrov, et al. Design, synthesis, and testing toward a 57-codon genome, Science 353, 819-822, 2016. Alternatively, quadruplet codons can be used to incorporate non-standard amino acids, using methods known to those of skill in the art. See Anderson, J. C. et al. An expanded genetic code with a functional quadruplet codon. Proc. Natl. Acad. Sci. U.S.A 101, 7566-7571, doi:10.1073/pnas.0401517101 (2004), Neumann, H., Wang, K., Davis, L., Garcia-Alai, M. & Chin, J. W. Encoding multiple unnatural amino acids via evolution of a quadruplet-decoding ribosome. Nature 464, 441-444, (2010) and Chatterjee, A., Lajoie, M. J., Xiao, H., Church, G. M. & Schultz, P. G. A Bacterial Strain with a Unique Quadruplet Codon Specifying Non-native Amino Acids. Chembiochem, n/a-n/a, doi: 10.1002/cbic.201402104 (2014) each of which are incorporated by reference in their entireties. An orthogonal aminoacyl-tRNA synthetase (aaRS)/tRNA pair is developed that specifically and efficiently decodes the quadruplet UAGA codon based on the non-functional UAG triplet resulting in unambiguous incorporation of non-standard amino acids, such as selenocysteine, at UAGA codons producing high protein yields. Such quadruplet codons may be used in the present methods.

Over 100 NSAAs with diverse chemistries have been synthesized and co-translationally incorporated into proteins using evolved orthogonal aminoacyl-tRNA synthetase (aaRSs)/tRNA pairs. See Liu, C. C. & Schultz, P. G. Adding new chemistries to the genetic code. An. Rev. Biochem. 79, 413-444, doi:10.1146/annurev.biochem.052308.105824 (2010), incorporated by reference in its entirety. Non-standard amino acids have been designed based on tyrosine or pyrrolysine. An aaRS/tRNA may be provided on a plasmid or into the genome of the genomically recoded organism. An orthogonal aaRS/tRNA pair is used to bioorthogonally incorporate NSAAs into proteins. Vector-based over-expression systems may be used to outcompete natural codon function with its reassigned function. See Wang, L., Brock, A., Herberich, B. & Schultz, P. G. Expanding the genetic code of Escherichia coli. Science 292, 498-500 (2001), Young, T. S., Ahmad, I., Yin, J. A. & Schultz, P. G. An enhanced system for unnatural amino acid mutagenesis in E. coli. Journal of Molecular Biology 395, 361-374 (2009), and Chatterjee, A., Sun, S. B., Furman, J. L., Xiao, H. & Schultz, P. G. A Versatile Platform for Single- and Multiple-Unnatural Amino Acid Mutagenesis in Escherichia coli. Biochemistry 52, 1828-1837, doi:10.1021/bi4000244 (2013) each of which are incorporated by reference in their entireties. If one completely abolishes natural UAG translation function, far lower aaRS/tRNA function may be sufficient to achieve efficient NSAA incorporation. GRO-based NSAA incorporation can use either vector- and/or genome-based aaRS/tRNA pairs. Genome-based aaRS/tRNA pairs have been used to reduce the mis-incorporation of canonical amino acids in the absence of available NSAAs (Mandell and Lajoie et al., Nature. 2015 Feb. 5; 518(7537):55-60. doi: 10.1038/nature14121, which is incorporated by reference).

Since the UAG codon function has been completely reassigned in the genomically recoded organism, NSAAs, such as selenocysteine, can be incorporated in the genomically recoded organism without any phenotypic consequences. NSAA incorporation in the genomically recoded organism may involve supplementing the growth media with the non-standard amino acid, such as selenocysteine, and an inducer for the aaRS. Alternatively, the aaRS may be expressed constitutively. Alternatively, as in the present disclosure, the endogenous seryl-tRNA synthetase may be used to serylate selenocysteine tRNA, which tRNA is acted upon by enzymes comprising selA and selD to produce tRNA$^{sec}$ (selenocysteine charged tRNA). Media may be supplemented with a selenium source like sodium selenite to improve production of tRNA$^{sec}$. The desired protein can be overexpressed using any desired protein overexpression system (e.g., T7-RNAP, constitutive incorporation, or inducible expression based on IPTG/allolactose, anhydrotetracycline, arabinose, rhamnose, or other inducible systems). The protein cross-link (diselenide bond) may form spontaneously based on proximity and orientation during protein folding, and the protein can be handled as any other overexpressed product.

Example 4

Methods

Sequences coding for the genes of interest were cloned into a chloramphenicol resistant vector with a T7 promoter controlled by a Tet-repressor. Vectors were transformed into 2×310 k cells with an integrated T7 RNA Polymerase controlled by a tet operon. Cells were grown to an OD~0.6 and induced with aTc at 100 ng/mL at room temperature overnight. Induced cells were pelleted and resuspended in 20 mM Tris pH 7.4, 100 mM NaCl, 20 mM imidazole, and 0.01% Triton X-100 followed by lysis by sonication. The lysates were centrifuged to separate and pellet. Supernate was run over Ni-affinity beads in the same buffer as lysis.

Figure 4:
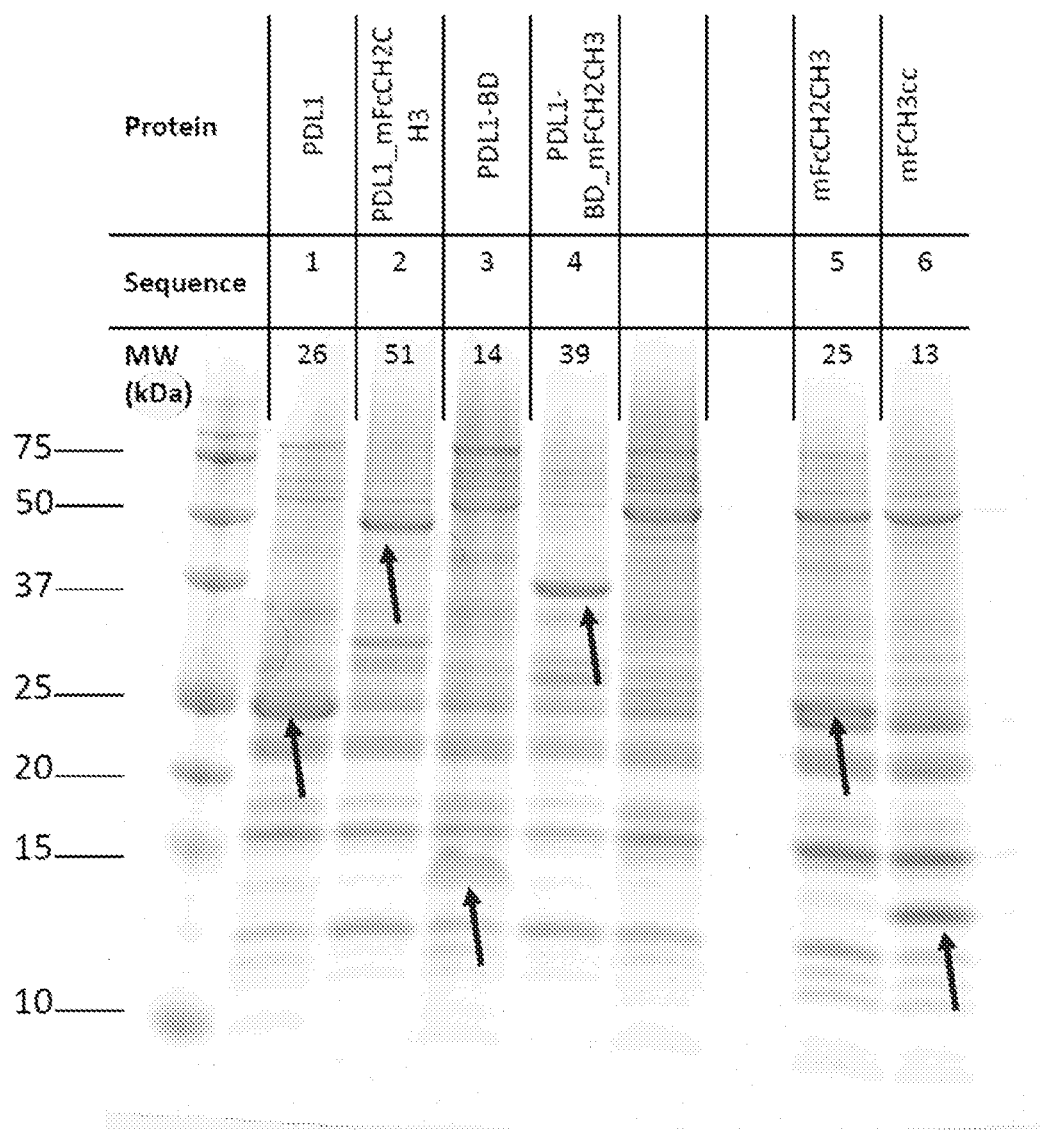
FIG. 4 shows protein expression for 6 different selenobiologics. Sequences 1-6 on the gel correspond to SEQ ID NO: 1620-1625 in the Sequence Listing. Diselenide bonds are at: SEQ ID NO: 1620 SeCys23-SeCys97 and SeCys138-SeCys192; SEQ ID NO: 1621 SeCys23-SeCys97, SeCys138-SeCys192, SeCys267-SeCys327, and SeCys373-SeCys431; SEQ ID NO: 1622 SeCys24-SeCys98; SEQ ID NO: 1623 SeCys24-SeCys98, SeCys164-SeCys224, and SeCys270-SeCys328; SEQ ID NO: 1624 SeCys32-SeCys92 and SeCys138-SeCys196; and SEQ ID NO: 1625 SeCys4-SeCys28 and SeCys86-SeCys92.
Figure 5:
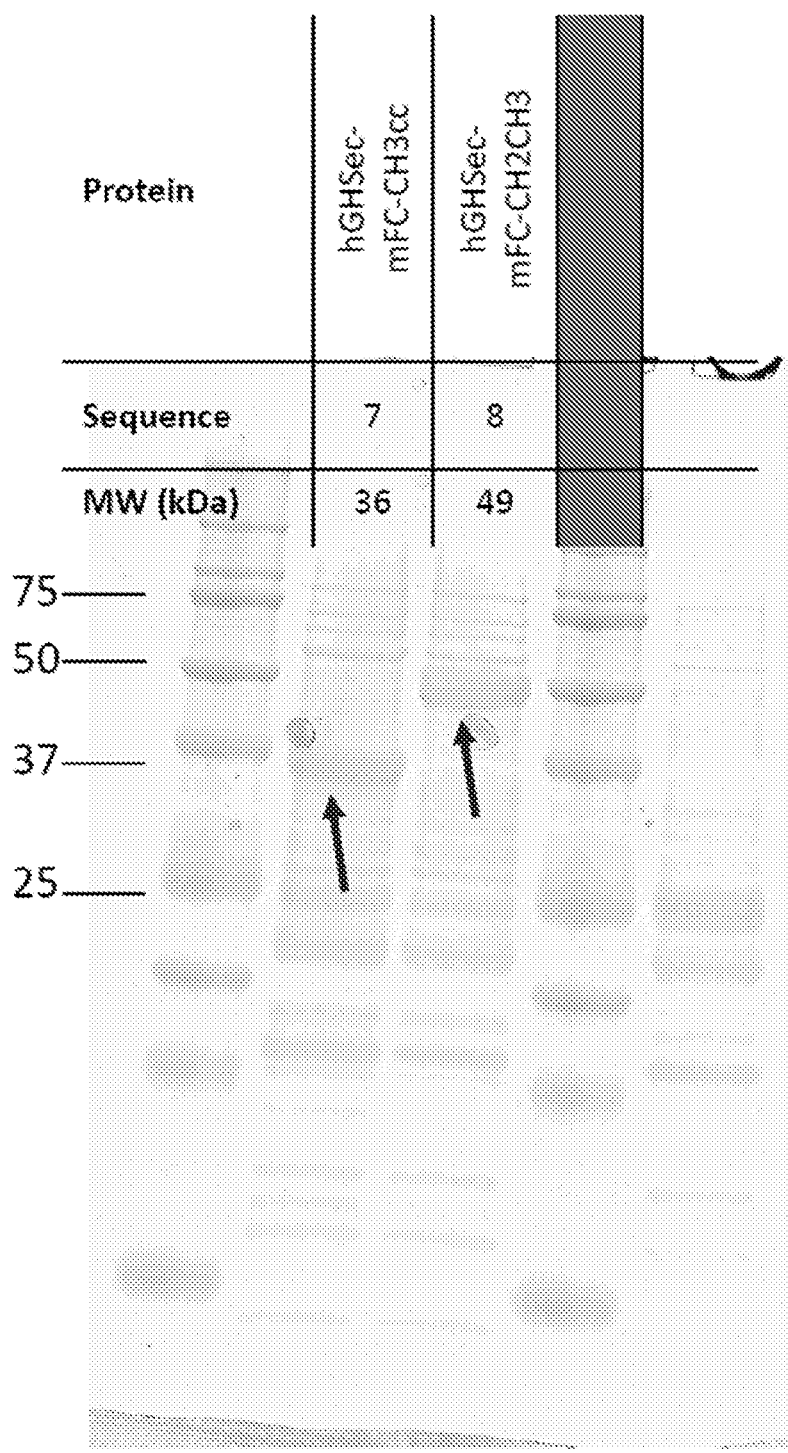
FIG. 5 shows protein expression for 2 different selenobiologics. Sequences 7-8 on the gel correspond to SEQ ID NO: 1626-1627 in the Sequence Listing. Diselenide bonds are at SEQ ID NO: 1626 SeCys183-SeCys190, SeCys210-SeCys234, and SeCys292-SeCys298; and SEQ ID NO: 1627 SeCys183-SeCys190, SeCys238-SeCys298, and SeCys344-SeCys402
Figure 6:
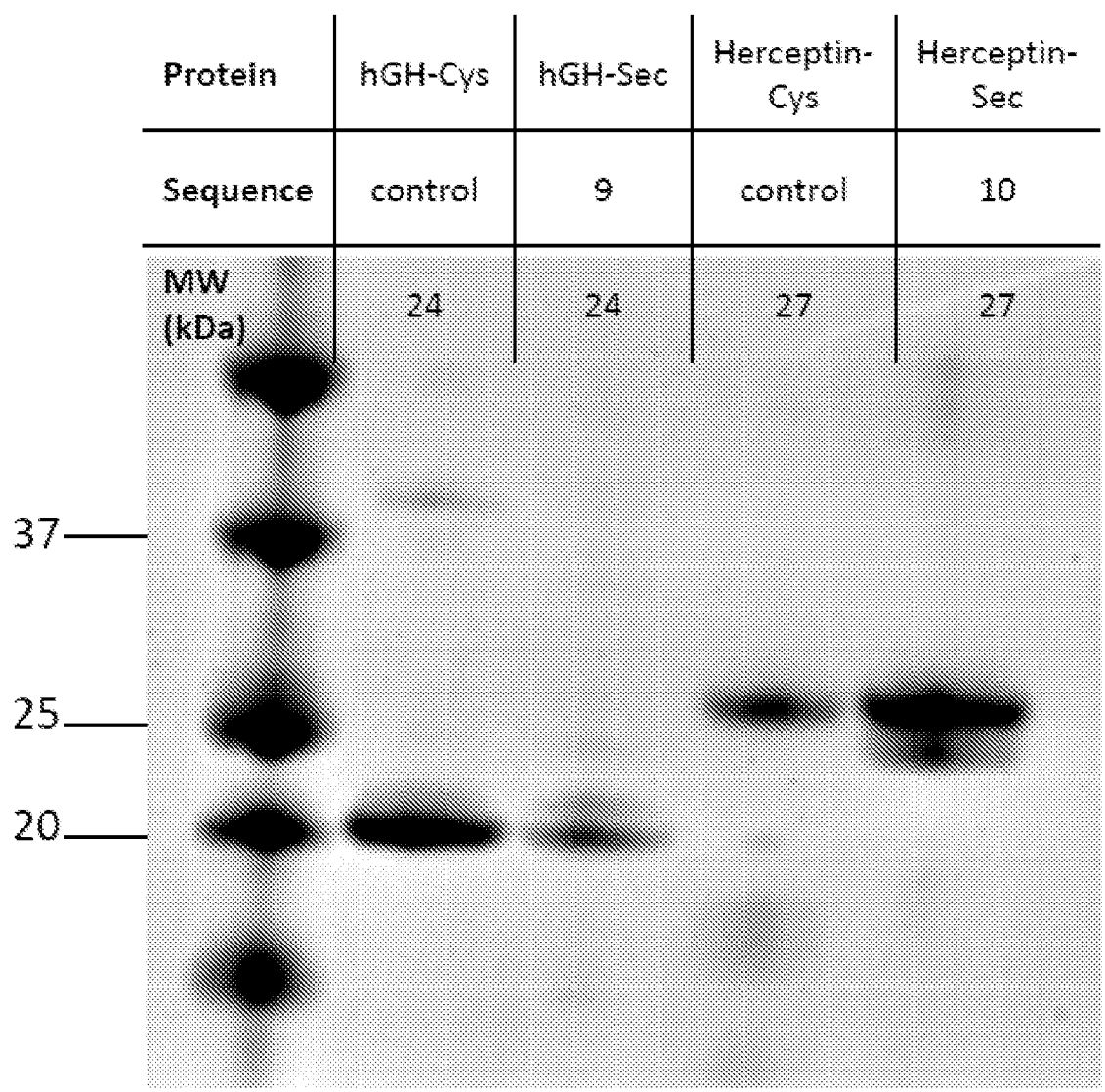
FIG. 6 shows protein expression for 2 different selenobiologics. Sequences 9-10 on the gel correspond to SEQ ID NO: 1628-1629 in the Sequence Listing. Diselenide bonds are at SEQ ID NO: 1628 SeCys54-SeCys166 and SeCys183-SeCys190; and SEQ ID NO: 1629 SeCys24-SeCys89 and SeCys149-SeCys244.
Figure 7A:
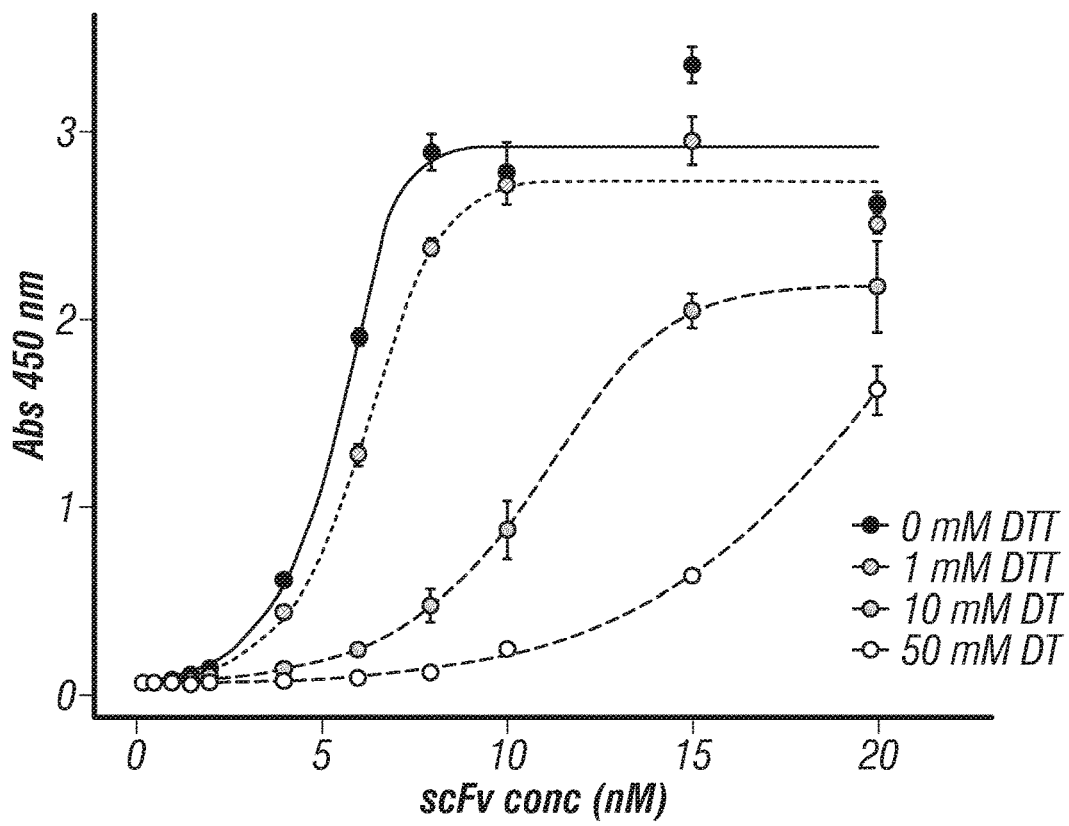
FIG. 7A-7B shows ELISA data for wild-type (disulfide) and seleno (diselenide) anti-RCA scFv in different redox conditions. Wild-type (A) and seleno (SEQ ID NO: 1631, B)-anti-RCA scFv were diluted to 1 µM in TBS pH 7.5 with 0, 1, 10 or 50 mM DTT and incubated for 16 hours at 37° C. Ricin A-chain (Sigma L9514) was diluted to 10 µg mL in PBS and bound to a 96-well plate overnight at 4° C. Control plates were bound with PBS containing 5% w/v skim milk. Plates were washed with PBS and blocked with PBS 5% w/v skim milk for two hours. Following incubation with DTT, scFvs were diluted in PBS with 5% w/v skim milk and 0.05% Tween 20 to 0, 0.25, 0.5, 1, 1.5, 2, 4, 6, 8, 10, 15 and 20 nM and bound in quadruplicate for two hours at 25° C. Secondary antibody (anti-polyhistidine-HRP, Sigma A7058) was diluted 1/10,000 in PBS with 5% w/v skim milk and 0.05% Tween 20 and bound for two hours at 25° C. Plates were incubated with TMB for 10 minutes at 25° C. with agitation and color development terminated by the addition of 2M H2SO4. Absorbance was immediately measured at 450 nm. All binding, blocking and enzymatic steps were performed on an orbital shaker at 450 rpm, and all washes were performed with PBS or PBS with 0.05% Tween 20. Only wild-type anti-RCA scFv showed substantial loss of binding at 1 and 10 mM DTT, and loss of binding was substantially abrogated at all concentrations for seleno-anti-RCA compared to WT scFv.
Figure 7B:
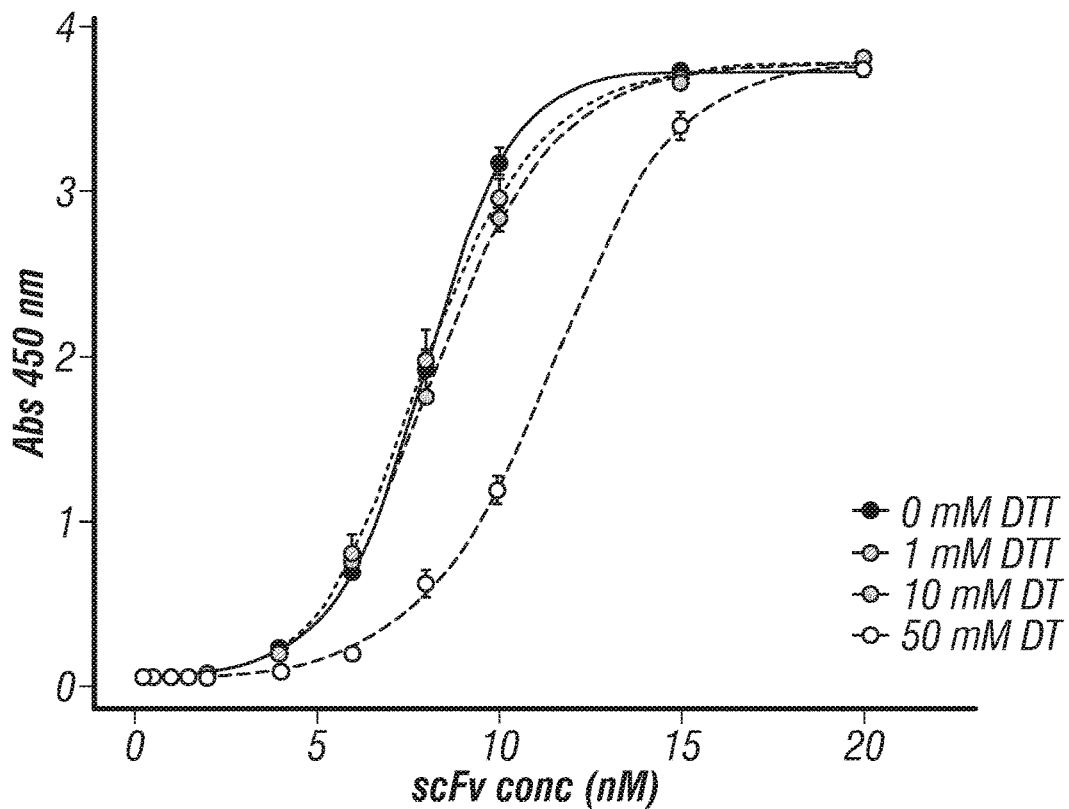
Figure 8A:
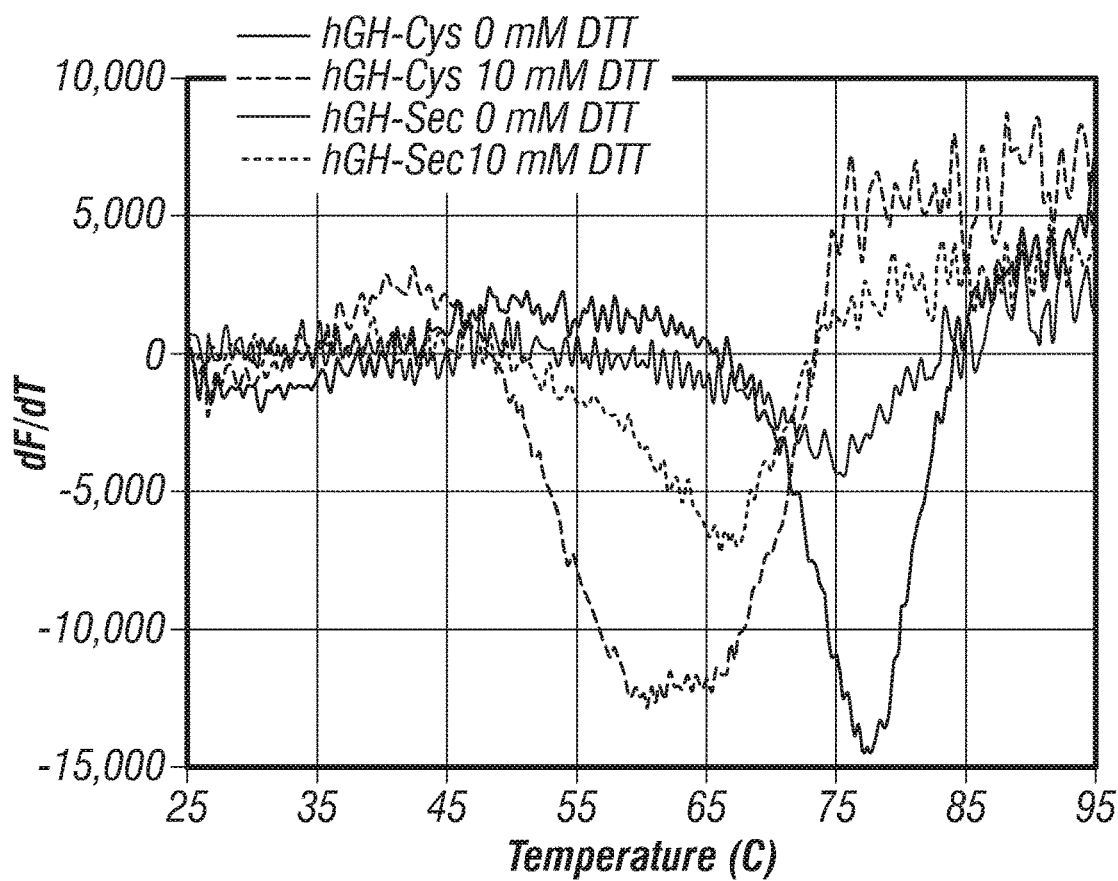
FIG. 8A-8B shows thermal shift data for wild-type (disulfide) and seleno (diselenide) variants of 2 different biologics. Thermal denaturation of purified wild-type and seleno (SEQ ID NO: 1132) hGH (A) and wild-type and seleno (SEQ ID NO: 1632) Herceptin scFv (B) in different reducing conditions was monitored using the Applied Biosystems Protein Thermal Shift dye on a QuantStudio 3 Real Time PCR system. The reducing agent DTT was added to triplicates of 5 µg of hGH-Cys/SeCys and 2 µg of Herceptin scFv-Cys/SeCys at concentrations of 0 M and 10 mM followed by incubation for 10 minutes at room temperature. The proteins were denatured in a linear ramp of 0.03° C./s from 25° C. to 98° C. Melting temperature ($T_m$) was determined by finding the minimum of dF/dT with Protein Thermal Shift Software (ThermoFisher). The hGH samples (A) showed a single minimum at both concentrations of DTT. The $T_m$ for hGH-Cys decreased from 77° C. without DTT to 60° C. in the presence of 10 mM DTT. The SeCys variant showed a marked stabilization under reducing conditions compared to the Cys variant, with a $T_m$ of 75° C. without DTT and a $T_m$ of 66° C. in 10 mM DTT. For Herceptin (B) the Cys variant showed two minima of dF/dT in both conditions. With addition of 10 mM DTT the dominant $T_m$ minima shifted from the minima at a higher temperature (70° C.) to the lower temperature (58° C.). In contrast, Herceptin-SeCys only had one minimum in both concentrations of DTT. Again, the SeCys variant showed stabilization under reducing conditions, with the $T_m$ decreasing from 68 C without DTT to 64 C in 10 mM DTT.
Figure 8B:
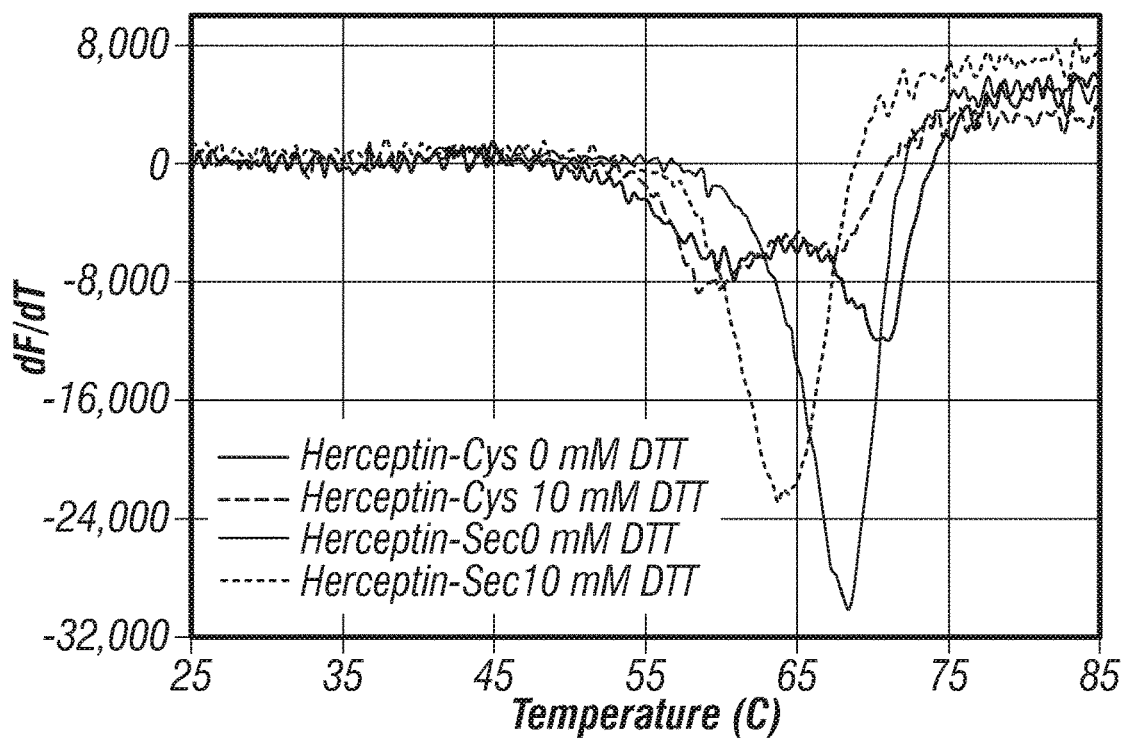

Proteins of interest were eluted in PBS pH7.4 with addition of 300 mM imidazole. Purified fractions were run on a SDS page gel. The results for 10 different selenobiologics are shown in FIGS. 4-6.

REFERENCES

The disclosure of each reference cited is expressly incorporated herein.
1. Anderson, J. C. et al. An expanded genetic code with a functional quadruplet codon. *Proc. Natl. Acad. Sci. U.S.A* 101, 7566-7571, doi:10.1073/pnas.0401517101 (2004),
2. Armishaw, C. J., Daly, N. L., Nevin, S. T., Adams, D. J., Craik, D. J. & Alewood, P. F. Alpha-selenoconotoxins, a new class of potent alpha7 neuronal nicotinic receptor antagonists. *J Biol Chem* 281, 14136-43 (2006).
3. Chatterjee, A., Lajoie, M. J., Xiao, H., Church, G. M. & Schultz, P. G. A Bacterial Strain with a Unique Quadruplet Codon Specifying Non-native Amino Acids. *Chembiochem*, n/a-n/a, doi:10.1002/cbic.201402104 (2014)
4. Chatterjee, A., Sun, S. B., Furman, J. L., Xiao, H. & Schultz, P. G. A Versatile Platform for Single- and Multiple-Unnatural Amino Acid Mutagenesis in *Escherichia coli*. Biochemistry 52, 1828-1837, doi:10.1021/bi4000244 (2013)
5. Lajoie, M. J. et al. Genomically recoded organisms expand biological functions. Science 342, 357-360, doi: 10.1126/science.1241459 (2013)
6. Lajoie, M. J. et al. Probing the limits of genetic recoding in essential genes. *Science* 342, 361-363, doi:10.1126/science.1241460 (2013)
7. Liu, C. C. & Schultz, P. G. Adding new chemistries to the genetic code. *An. Rev. Biochem.* 79, 413-444, doi: 10.1146/annurev.biochem.052308.105824 (2010)
8. Mandell and Lajoie et al., *Nature*. 2015 Feb. 5; 518(7537): 55-60. doi: 10.1038/nature14121,
9. Muttenthaler, M., Andersson, A., de Araujo, A. D., Dekan, Z., Lewis, R. J. & Alewood, P. F. Modulating oxytocin activity and plasma stability by disulfide bond engineering. *J Med Chem* 53, 8585-96 (2010).
10. Neumann, H., Wang, K., Davis, L., Garcia-Alai, M. & Chin, J. W. Encoding multiple unnatural amino acids via evolution of a quadruplet-decoding ribosome. *Nature* 464, 441-444, (2010)
11. Ostrov, et al. Design, synthesis, and testing toward a 57-codon genome, *Science* 353, 819-822, 2016
12. Safavi-Hemami, H., Gajewiak, J., Karanth, S., Robinson, S. D., Ueberheide, B., Douglass, A. D., Schlegel, A., Imperial, J. S., Watkins, M., Bandyopadhyay, P. K., Yandell, M., Li, Q., Purcell, A. W., Norton, R. S., Ellgaard, L. & Olivera, B. M. Specialized insulin is used for chemical warfare by fish-hunting cone snails. *Proc Natl Acad Sci USA* 112, 1743-8 (2015).
13. Thyer, R. et al. Evolving tRNA$^{Sec}$ for Efficient Canonical Incorporation of Selenocysteine. *JACS* 137(1), 46-49, (2015)
14. Wang, L., Brock, A., Herberich, B. & Schultz, P. G. Expanding the genetic code of *Escherichia coli*. Science 292, 498-500 (2001)
15. Young, T. S., Ahmad, I., Yin, J. A. & Schultz, P. G. An enhanced system for unnatural amino acid mutagenesis in *E. coli*. Journal of Molecular Biology 395, 361-374 (2009),

SEQUENCE LISTING (1632 sequences)

SEQ ID NO: 1 - protein, 330 aa, Artificial Sequence
  Synthesized sequence with two or more selenocysteine residues substituted for two or more cysteine residues
  VARIANT (1)...(330): Xaa = selenocysteine or cysteine
ASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 2 - protein, 326 aa, Artificial Sequence
  Synthesized sequence with two or more selenocysteine residues substituted for two or more cysteine residues
  VARIANT (1)...(326): Xaa = selenocysteine or cysteine
ASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDISVEWESNGQPENNYKTTPPMLDSDGSFFLYSKLTVDKSRWQQGNVFSXSVMHEALHNHYTQKSLSLSPGK

SEQ ID NO: 3 - protein, 377 aa, Artificial Sequence
  Synthesized sequence with two or more selenocysteine residues substituted for two or more cysteine residues
  VARIANT (1)...(377): Xaa = selenocysteine or cysteine
ASTKGPSVFPLAPXSRSTSGGTAALGXLVKDYFPEPVTVSWNSGALTSGVHTFPAVLQSSGLYSLSSVVTVPSSSLGTQTYTXNVNHKPSNTKVDKRVELKTPLGDTTHTXPRXPEPKSXDTPPPXPRXPEPKSXDTPPPXPRXPEPKSXDTPPPXPRXPAPELLGGPSVFLFPPKPKDTLMISRTPEVTXVVVDVSHEDPEVQFKWYVDGVEVHNAKTKPREEQYNSTFRVVSVLTVLHQDWLNGKEYKXKVSNKALPAPIEKTISKTKGQPREPQVYTLPPSREEMTKNQVSLTXLVKGFYPSDIAVEWESSGQPENNYNTTPPMLDSDGSFFLYSKLTVDKSRWQQGNIFSXSVMHEALHNRFTQKSLSLSPGK

SEQ ID NO: 4 - protein, 327 aa, Artificial Sequence
  Synthesized sequence with two or more selenocysteine residues substituted for two or more cysteine residues
  VARIANT (1)...(327): Xaa = selenocysteine or cysteine
ASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 5 - protein, 353 aa, Artificial Sequence
  Synthesized sequence with two or more selenocysteine residues substituted for two or more cysteine residues
  VARIANT (1)...(353): Xaa = selenocysteine or cysteine
ASPTSPKVFPLSLXSTQPDGNVVIAXLVQGFFPQEPLSVTWSESGQGVTARNFPPSQDASGDLYTTSSQLTLPATQXLAGKSVTXHVKHYTNPSQDVTVPXPVPSTPPTPSPSTPPTPSPSXXHPRLSLHRPALEDLLLGSEANLTXTLTGLRDASGVTFTWTPSSGKSAVQGPPERDLXGXYSVSSVLPGXAEPWNHGKTFTXTAAYPESKTPLTATLSKSGNTFRPEVHLLPPPSEELALNELVTLTXLARGFSPKDVLVRWLQGSQELPREKYLTWASRQEPSQGTTTFAVTSILRVAAEDWKKGDTFSXMVGHEALPLAFTQKTIDRLAGKPTHVNVSVVMAEVDGTXY

SEQ ID NO: 6 - protein, 340 aa, Artificial Sequence
  Synthesized sequence with two or more selenocysteine residues substituted for two or more cysteine residues
  VARIANT (1)...(340): Xaa = selenocysteine or cysteine
ASPTSPKVFPLSLDSTPQDGNVVVAXLVQGFFPQEPLSVTWSESGQNVTARNFPPSQDASGDLYTTSSQLTLPATQXPDGKSVTXHVKHYTNPSQDVTVPXPVPPPPPXXHPRLSLHRPALEDLLLGSEANLTXTLTGLRDASGATFTWTPSSGKSAVQGPPERDLXGXYSVSSVLPGXAQPWNHGETFTXTAAHPELKTPLTANITKSGNTFRPEVHLLPPPSEELALNELVTLTXLARGFSPKDVLVRWLQGSQELPREKYLTWASRQEPSQGTTTFAVTSILRVAAEDWKKGDTFSXMVGHEALPLAFTQKTIDRMAGKPTHVNVSVVMAEVDGTXY

SEQ ID NO: 7 - protein, 473 aa, Artificial Sequence
  Synthesized sequence with two or more selenocysteine residues substituted for two or more cysteine residues
  VARIANT (1)...(473): Xaa = selenocysteine or cysteine
GSASAPTLFPLVSXENSPSDTSSVAVGXLAQDFLPDSITLSWKYKNNSDISSTRGFPSVLRGGKYAATSQVLLPSKDVMQGTDEHVVXKVQHPNGNKEKNVPLPVIAELPPKVSVFVPPRDGFFGNPRKSKLIXQATGFSPRQIQVSWLREGKQVGSGVTTDQVQAEAKESGPTTYKVTSTLTIKESDWLGQSMFTXRVDHRGLTFQQNASSMXVPDQDTAIRVFAIPPSFASIFLTKSTKLTXLVTDLTTYDSVTISWTRQNGEAVKTHTNISESHPNATFSAVGEASIXEDDWNSGERFTXTVTHTDLPSPLKQTISRPKGVALHRPDVYLLPPAREQLNLRESATITXLVTGFSPADVFVQWMQRGQPLSPEKYVTSAPMPEPQAPGRYFAHSILTVSEEEWNTGETYTXVAHEALPNRVTERTVDKSTEGEVSADEEGFENLWATASTFIVLFLLSLFYSTTVTLFKVK

SEQ ID NO: 8 - protein, 430 aa, Artificial Sequence
  Synthesized sequence with two or more selenocysteine residues substituted for two or more cysteine residues
  VARIANT (1)...(430): Xaa = selenocysteine or cysteine
APTKAPDVFPIISGXRHPKDNSPVVLAXLITGYHPTSVTVTWYMGTQSQPQRTFPEIQRRDSYYMTSSQLSTPLQQWRQGEYKXVVQHTASKSKKEIFRWPESPKAQASSVPTAQPQAEGSLAKATTAPATTRNTGRGGEEKKKEKEKEEQEERETKTPEXPSHTQPLGVYLLTPAVQDLWLRDKATFTXFVVGSDLKDAHLTWEVAGKVPTGGVEEGLLERHSNGSQSQHSRLTLPRSLWNAGTSVTXTLNHPSLPPQRLMALREPAAQAPVKLSLNLLASSDPPEAASWLLXEVSGFSPPNILLMWLEDQREVNTSGFAPARPPPQPGSTTFWAWSVLRVPAPPSPQPATYTXVVSHEDSRTLLNASRSLEVSYLAMTPLIPQSKDENSDDYTTFDDVGSLWTTLSTFVALFILTLLYSGIVTFIKVK

SEQ ID NO: 9 - protein, 428 aa, Artificial Sequence
  Synthesized sequence with two or more selenocysteine residues substituted for two or more cysteine residues
  VARIANT (1)...(428): Xaa = selenocysteine or cysteine
ASTQSPSVFPLTRXXKNIPSNATSVTLGXLATGYFPEPVMVTWDTGSLNGTTMTLPATTLTLSGHYATISLLTVSGAWAKQMFTXRVAHTPSSTDWVDNKTFSVXSRDFTPPTVKILQSSXDGGGHFPPTIQLLXLVSGYTPGTINITWLEDGQVMDVDLSTASTTQEGELASTQSELTLSQKHWLSDRTYTXQVTYQGHTFEDSTKKXADSNPRGVSAYLSRPSPFDLFIRKSPTITXLVVDLAPSKGTVNLTWSRASGKPVNHSTRKEEKQRNGTLTVTSTLPVGTRDWIEGETYQXRVTHPHLPRALMRSTTKTSGPRAAPEVYAFATPEWPGSRDKRTLAXLIQNFMPEDISVQWLHNEVQLPDARHSTTQPRKTKGSGFFVFSRLEVTRAEWEQKDEFIXRAVHEAASPSQTVQRAVSVNPGK

SEQ ID NO: 10 - protein, 106 aa, Artificial Sequence
  Synthesized sequence with two or more selenocysteine residues substituted for two or more cysteine residues
  VARIANT (1)...(106): Xaa = selenocysteine or cysteine
TVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 11 - protein, 106 aa, Artificial Sequence
  Synthesized sequence with two or more selenocysteine residues substituted for two or more cysteine residues
  VARIANT (1)...(106): Xaa = selenocysteine or cysteine
GQPKANPTVTLFPPSSEELQANKATLVXLISDFYPGAVTVAWKADGSPVKAGVETTKPSKQSNNKYAASSYLSLTPEQWKSHRSYSXQVTHEGSTVEKTVAPTEXS

SEQ ID NO: 12 - protein, 106 aa, Artificial Sequence
  Synthesized sequence with two or more selenocysteine residues substituted for two or more cysteine residues
  VARIANT (1)...(106): Xaa = selenocysteine or cysteine
GQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 13 - protein, 106 aa, Artificial Sequence
  Synthesized sequence with two or more selenocysteine residues substituted for two or more cysteine residues
  VARIANT (1)...(106): Xaa = selenocysteine or cysteine
GQPKAAPSVTLFPPSSEELQANKATLVXLISDFYPGAVTVAWKADSSPAKAGVETTTPSKQSNNKYAASSYLSLTPEQWKSHKSYSXQVTHEGSTVEKTVAPTEXS

SEQ ID NO: 14 - protein, 106 aa, Artificial Sequence
  Synthesized sequence with two or more selenocysteine residues substituted for two or more cysteine residues
  VARIANT (1)...(106): Xaa = selenocysteine or cysteine
GQPKAAPSVTLFPPSSEELQANKATLVXLISDFYPGAVKVAWKADGSPVNTGVETTTPSKQSNNKYAASSYLSLTPEQWKSHRSYSXQVTHEGSTVEKTVAPAEXS

SEQ ID NO: 15 - protein, 106 aa, Artificial Sequence
  Synthesized sequence with two or more selenocysteine residues substituted for two or more cysteine residues
  VARIANT (1)...(106): Xaa = selenocysteine or cysteine
GQPKAAPSVTLFPPSSEELQANKATLVXLVSDFYPGAVTVAWKADGSPVKVGVETTKPSKQSNNKYAASSYLSLTPEQWKSHRSYSXRVTHEGSTVEKTVAPAEXS

SEQ ID NO: 16 - protein, 117 aa, Artificial Sequence
  Synthesized sequence with two or more selenocysteine residues substituted for two or more cysteine residues
  VARIANT (1)...(117): Xaa = selenocysteine or cysteine
EVMLVESGGVLVKPGGSLKLSXAASGFTFSRYAMSWVRQTPEKRLEWVATISSGGSYSYYPDSVKGRFTISRDNVKNTLYLQMSSLRSEDTAMYYXARDSGGFAYWGQGTLVTVSAA

SEQ ID NO: 17 - protein, 123 aa, Artificial Sequence
  Synthesized sequence with two or more selenocysteine residues substituted for two or more cysteine residues
  VARIANT (1)...(123): Xaa = selenocysteine or cysteine
EIQLQQSGVELVRPGASVTLSXKASGYTFTDYDMHWVKQTPVHGLEWIGTIDPETGGTAYNQKFKGKATLTADRSSTTAYMELSSLTSEDSAVYYXTSFYYTYSNYDVGFAYWGQGTLVTVSA

SEQ ID NO: 18 - protein, 123 aa, Artificial Sequence
  Synthesized sequence with two or more selenocysteine residues substituted for two or more cysteine residues
  VARIANT (1)...(123): Xaa = selenocysteine or cysteine
EVTLRESGPGLVKPTQTLTLTXTLYGFSLSTSDMGVDWIRQPPGKGLEWLAHIWWDDVKRYNPALKSRLTISKDTSKNQVVLKLTSVDPVDTATYYXARTVSSGYIYYAMDYWGQGTLVTVVS

SEQ ID NO: 19 - protein, 122 aa, Artificial Sequence
  Synthesized sequence with two or more selenocysteine residues substituted for two or more cysteine residues
  VARIANT (1)...(122): Xaa = selenocysteine or cysteine
EVQLVQSGTEVKKPGESLKISXKGSGYTVTSYWIGWVRQMPGKGLEWMGFIYPGDSETRYSPTFQGQVTISADKSFNTAFLQWSSLKASDTAMYYXARVGSGWYPYTFDIWGQGTMVTVSSA

SEQ ID NO: 20 - protein, 117 aa, Artificial Sequence
  Synthesized sequence with two or more selenocysteine residues substituted for two or more cysteine residues
  VARIANT (1)...(117): Xaa = selenocysteine or cysteine
QVQLVESGGGVVQPGRSLRLSXAASGFTFSSYGMLWVRQAPGKGLEWVADISYDGSNKYYADSVKGRFTISRDNSKNTLYLQMNSLRAEDTAVFYXARDRIAVADYWGQGTLVTVSS

SEQ ID NO: 21 - protein, 119 aa, Artificial Sequence
  Synthesized sequence with two or more selenocysteine residues substituted for two or more cysteine residues
  VARIANT (1)...(119): Xaa = selenocysteine or cysteine
QVQLVQSGAEVKKPGASVKVSXKASGYTFTNYWMHWVRQAPGQGLEWMGEINPSHGRTIYAQKFQGRVTMTRDTSTSTVYMELSSLRSEDTAVYYXARGGLGPAWFAYWGQGTLVTVSS

SEQ ID NO: 22 - protein, 119 aa, Artificial Sequence
  Synthesized sequence with two or more selenocysteine residues substituted for two or more cysteine residues
  VARIANT (1)...(119): Xaa = selenocysteine or cysteine
EVQLVQSGAEVKKPGESLKISXKVSGYFFTTYWIGWVRQMPGKGLEYMGIIYPGDSDTRYSPSFQGQVTISADKSISTAYLQWSSLKASDTAMYYXARGGNWNXFDYWGQGTLVTVSSA

SEQ ID NO: 23 - protein, 117 aa, Artificial Sequence
  Synthesized sequence with two or more selenocysteine residues substituted for two or more cysteine residues
  VARIANT (1)...(117): Xaa = selenocysteine or cysteine
EVQLVQSGAEVKKPGESLKISXKGSGYNFTSYWIGWVRQMPGKGLELMGIIYPGDSDTRYSPSFQGQVTISADKSISTAYLQWSSLKASDTAMYYXGSGSYFYFDLWGRGTLVTVSS

SEQ ID NO: 24 - protein, 120 aa, Artificial Sequence
  Synthesized sequence with two or more selenocysteine residues substituted for two or more cysteine residues
  VARIANT (1)...(120): Xaa = selenocysteine or cysteine
QVQLVESGGGVVQPGRSLRLSXAASGFSFSSTYVXWVRQAPGKGLEWIAXIYTGDGTNYSASWAKGRFTISKDSSKNTVYLQMNSLRAEDTAVYFXARPDITYGFAINFWGPGTLVTVSS

SEQ ID NO: 25 - protein, 120 aa, Artificial Sequence
  Synthesized sequence with two or more selenocysteine residues substituted for two or more cysteine residues
  VARIANT (1)...(120): Xaa = selenocysteine or cysteine
EVQLVESGGGLVQPGGSLRLSXAVSGFSLSSYYMSWVRQAPGKGLEWIGITTTSTNTFYASWAKGRFTISKDSSKNTVYLQMNSPRAEDTAVYFXARYGGNSAYYAFSLWGQGTLVTVSS

SEQ ID NO: 26 - protein, 121 aa, Artificial Sequence
  Synthesized sequence with two or more selenocysteine residues substituted for two or more cysteine residues
  VARIANT (1)...(121): Xaa = selenocysteine or cysteine
QVQLQQWGAGLLKPSETLSLTXAVYGGSFSGYYWSWVRQPPGKGLEWIGEIDHSGSTNNNPSLKSRVTISVGTSKNQFSLKLSSVTAADTAVYYXSRDGGPESGMGAFDIWGQGTMVTVSS

SEQ ID NO: 27 - protein, 127 aa, Artificial Sequence
  Synthesized sequence with two or more selenocysteine residues substituted for two or more cysteine residues
  VARIANT (1)...(127): Xaa = selenocysteine or cysteine
QVQLVQSGAEVKKPGASVKVSXKASGGTFSSYAISWVRQAPGQGLEWMGGFDPEDGETIYAQKFQGRVTMTEDTSTDTAYMELSSLRSEDTAVYYXATGRSMVRGVIIPFNGMDVWGQGTTVTVSSK

SEQ ID NO: 28 - protein, 118 aa, Artificial Sequence
  Synthesized sequence with two or more selenocysteine residues substituted for two or more cysteine residues
  VARIANT (1)...(118): Xaa = selenocysteine or cysteine
QVQLQQSGAELVGPGSSVKISXKASGYAFSSYWMNWVKQRPGQGLEWIGQIYPGDGDTNYNGKFRGKVTLTADRSSSTADMQLSSLTSEDSAVYFXARDDGYEGFDYWGQGTTLTVSS

SEQ ID NO: 29 - protein, 122 aa, Artificial Sequence
  Synthesized sequence with two or more selenocysteine residues substituted for two or more cysteine residues
  VARIANT (1)...(122): Xaa = selenocysteine or cysteine
EVKLVESGGGLVKPGGSLNISXAASGFTFSNYVMSWVRQTPEKRLEWVATISSGDNYMYYPDSVKGRFTISSDNAKNTLFLQMSSLRSEDTALYYXARHFDNYEGNSMDYWGQGTSVTVSSA

SEQ ID NO: 30 - protein, 116 aa, Artificial Sequence
  Synthesized sequence with two or more selenocysteine residues substituted for two or more cysteine residues
  VARIANT (1)...(116): Xaa = selenocysteine or cysteine
EVQLLESGGGLVQPGGSLRLSXAASGFTFSNYWMGWVRQAPGKGLEWVSYIRSSGGLTHYADSVKGRFTISRDNSKNTLYLQMNSLRAEDTATYYXAKGLYSFDYWGQGTLVTVSS

SEQ ID NO: 31 - protein, 121 aa, Artificial Sequence
  Synthesized sequence with two or more selenocysteine residues substituted for two or more cysteine residues
  VARIANT (1)...(121): Xaa = selenocysteine or cysteine
EVQLVESGGGLVQPGGSLRLSXAASGFDFSRFWMSWVRQAPGKGLEWIGEVNPDNNTMNYTPSLKDKFTLSRDNAKNTLYLQMNSLRAEDTAVYYXARPPYYGSYGGFAYWGQGTLVTVSS

SEQ ID NO: 32 - protein, 106 aa, Artificial Sequence
  Synthesized sequence with two or more selenocysteine residues substituted for two or more cysteine residues
  VARIANT (1)...(106): Xaa = selenocysteine or cysteine
GPGLAAPSQSLSITXTVSGFSLTSYVISWVRQPPGKGLEWLGVIWTGGGTNYNSALKSRLSISKDNSKSQVSLKMNSLQTDDTARYYXASLSYDGFDYWGQGTTVT

SEQ ID NO: 33 - protein, 126 aa, Artificial Sequence
  Synthesized sequence with two or more selenocysteine residues substituted for two or more cysteine residues
  VARIANT (1)...(126): Xaa = selenocysteine or cysteine
EVQLVQSGAEVKKPGESLKISXKGSGYNFISHWIGWVRQMPGKGLEWMGMIYPGDSDTRYSPSFQGQVTISADKSINTAYLQWRSLKASDTAMYFXARHGGITGTTFYYDFGMDVWGQGTTVTVSS

SEQ ID NO: 34 - protein, 115 aa, Artificial Sequence
  Synthesized sequence with two or more selenocysteine residues substituted for two or more cysteine residues
  VARIANT (1)...(115): Xaa = selenocysteine or cysteine
QVQLVQSGAELKKPGASVKVSXKASGYTFTSYWINWIRQAPGQGLEWIGRIAPGSGTTYYNEVFKGRVTITVDKSTSTAYMELSSLRSEDTAVYFXARGDYGSYWGQGTLVTVSS

SEQ ID NO: 35 - protein, 120 aa, Artificial Sequence
  Synthesized sequence with two or more selenocysteine residues substituted for two or more cysteine residues
  VARIANT (1)...(120): Xaa = selenocysteine or cysteine
QVQLQESGPGLVKPSETLSLTXTVSGGSISSYYWSWIRQPPGRGLEWIGYFFYSGYTNYNPSLKSRVTMSVDTSKNQFSLKLSSVTAADTAVYYXAXITGTTKGGMDVWGQGATVTVSSA

SEQ ID NO: 36 - protein, 116 aa, Artificial Sequence
  Synthesized sequence with two or more selenocysteine residues substituted for two or more cysteine residues
  VARIANT (1)...(116): Xaa = selenocysteine or cysteine
QVQLVESGGGLVQPGGSLRLSXAASGFTFSSYWMSWVRQAPGKGLEWVSGISYSGSNTHYADSVKGRFTISRDNSKNTLYLQMNSLRAEDTAVYYXARMGIDLDYWGQGTLVTVSS

SEQ ID NO: 37 - protein, 117 aa, Artificial Sequence
  Synthesized sequence with two or more selenocysteine residues substituted for two or more cysteine residues
  VARIANT (1)...(117): Xaa = selenocysteine or cysteine
EVQLLESGGGLVQPGGSLRLSXAASGFTFSNAWMSWVRQAPGKGLEWVAFIWYDGSNKYYADSVKGRFTISRDNSKNTLYLQMNSLRAEDTAVYYXARYSGWYFDYWGQGTLVTVSS

SEQ ID NO: 38 - protein, 120 aa, Artificial Sequence
  Synthesized sequence with two or more selenocysteine residues substituted for two or more cysteine residues
  VARIANT (1)...(120): Xaa = selenocysteine or cysteine
QVQLQQWGAGLLKPSETLSLTXAVYGGSFSDYYWNWIRQPPGKGLEWIGEINHRGSTNSNPSLKSRVTLSLDTSKNQFSLKLRSVTAADTAVYYXAFGYSDYEYNWFDPWGQGTLVTVSS

SEQ ID NO: 39 - protein, 131 aa, Artificial Sequence
  Synthesized sequence with two or more selenocysteine residues substituted for two or more cysteine residues
  VARIANT (1)...(131): Xaa = selenocysteine or cysteine
EVHLVESGGGLVQPGGSLRLSXAASGFTFSRYWMSWVRQAQGKGLEWVASIKQAGSEKTYVDSVKGRFTISRDNAKNSLSLQMNSLRAEDTAVYYXAREGAYYYDSASYYPYYYYYSMDVWGQGTTVTVSS

SEQ ID NO: 40 - protein, 118 aa, Artificial Sequence
  Synthesized sequence with two or more selenocysteine residues substituted for two or more cysteine residues
  VARIANT (1)...(118): Xaa = selenocysteine or cysteine
EVQLVESGGGLVQPGGSLRLSXAASGFTFSSYSMNWVRQAPGKGLEWVSYISSSSSTIDYADSVKGRFTISRDNAKNSLYLQMNSLRDEDTAVYYXARESGWYLFDYWGQGTLVTVSS

SEQ ID NO: 41 - protein, 117 aa, Artificial Sequence
  Synthesized sequence with two or more selenocysteine residues substituted for two or more cysteine residues
  VARIANT (1)...(117): Xaa = selenocysteine or cysteine
EVQLVESGGGLVQPGGSLRLSXAASGFSFATYGVHWVRQSPGKGLEWLGVIWRGGSTDYSAAFMSRLTISKDNSKNTVYLQMNSLRAEDTAVYFXAKQAYGHYMDYWGQGTSVTVSS

SEQ ID NO: 42 - protein, 119 aa, Artificial Sequence
  Synthesized sequence with two or more selenocysteine residues substituted for two or more cysteine residues
  VARIANT (1)...(119): Xaa = selenocysteine or cysteine
QVELLESGGGLVQPGGSLRLSXAASGFTFDDYGMSWVRQAPGKGLEWVAVISYDGSNKYYADSVKGRFTISRDNSQNTLYLQMNSLRAEDTAVYYXASPLESPVAFDIWGQGTMVIVSS

SEQ ID NO: 43 - protein, 119 aa, Artificial Sequence
  Synthesized sequence with two or more selenocysteine residues substituted for two or more cysteine residues
  VARIANT (1)...(119): Xaa = selenocysteine or cysteine
QVQLQQPGAELVKPGASVKLSXKASGYTFTNYWMHWVKQRPGQGLEWIGEINPSHGRTIYNENFKSKATLTVDKSSITAFMQLSSLTSEDSAVYFXARGGLGPAWFAYWGQGTLVTVSA

SEQ ID NO: 44 - protein, 126 aa, Artificial Sequence
  Synthesized sequence with two or more selenocysteine residues substituted for two or more cysteine residues
  VARIANT (1)...(126): Xaa = selenocysteine or cysteine
QVTLRESGPALVKPTQTLTLTXTFSGFSLSTSGMXVSWIRQPPGKALEWLALIDWDDDKYYSTSLKTRLTISKDTSKNQVVLTMTNMDPVDTATYYXARILVDIVATITNDAFDVWGQGTMVTVSS

SEQ ID NO: 45 - protein, 129 aa, Artificial Sequence
  Synthesized sequence with two or more selenocysteine residues substituted for two or more cysteine residues
  VARIANT (1)...(129): Xaa = selenocysteine or cysteine
EVQLVESGGGLVQPGGSLRLSXAASGFTFSSYDMHWVRQATGKGLEWVSAIGTAGDTYYPDSVKGRFTISRENAKNSLYLQMNSLRAGDTAVYYXVREGTYYHDSGSDNYYSYGMDVWGQGTTVTVSSA

SEQ ID NO: 46 - protein, 123 aa, Artificial Sequence
  Synthesized sequence with two or more selenocysteine residues substituted for two or more cysteine residues
  VARIANT (1)...(123): Xaa = selenocysteine or cysteine
EVQLVESGGDLVKPGGSLKLSXAASGFTFSDYYMYWVRQTPEKRLEWVATINDGGTHTYYPDSLKGRFTISRDNAKNILYLQMSSLMSEDTAMYYXARDDYYYGSHFDAMDYWGQGTSVTVSS

SEQ ID NO: 47 - protein, 124 aa, Artificial Sequence
  Synthesized sequence with two or more selenocysteine residues substituted for two or more cysteine residues
  VARIANT (1)...(124): Xaa = selenocysteine or cysteine
QVTLKESGPGILQPSQTLSLTXSFSGFSLSTSGMGVSWIRQPSGKGLEWLAHIYWDDDKRYNPSLKSRLTISKDTSRNQVFLKITSVDTTDTATYYXTRSSGSIVIATGFAYWGQGTLVTVSAA

SEQ ID NO: 48 - protein, 119 aa, Artificial Sequence
  Synthesized sequence with two or more selenocysteine residues substituted for two or more cysteine residues
  VARIANT (1)...(119): Xaa = selenocysteine or cysteine
EVQLLESGGGLVQPGGSLRLSXAASGFTFSSYAMSWVRQAPGKGLEWVSAISGSGGSTYYADSVKGRFTISRDNSKNTLYLQMNSLRAEDTAVYYXARDLIHGVTRNWGQGTLVTVSSA

SEQ ID NO: 49 - protein, 119 aa, Artificial Sequence
  Synthesized sequence with two or more selenocysteine residues substituted for two or more cysteine residues
  VARIANT (1)...(119): Xaa = selenocysteine or cysteine
DVQLVESGGGLVKPGGSLKLSXAASGFDFSRYDMSWVRQTPEKRLEWVAYISSGGGSTYFPDTVKGRFTISRDNAKNTLYLQMNNLQSEDTAMFYXARQNKKLTWFDYWGQGTLVTVSS

SEQ ID NO: 50 - protein, 121 aa, Artificial Sequence
  Synthesized sequence with two or more selenocysteine residues substituted for two or more cysteine residues
  VARIANT (1)...(121): Xaa = selenocysteine or cysteine
QVQLVQSGAEVVKPGSSVKVSXKASGYTFTDYNVDWVKQAPGQGLQWIGNINPNNGGTIYNQKFKGKGTLTVDKSTSTAYMELSSLTSEDTAVYYXARSAFYNNYEYFDVWGQGTTVTVSS

SEQ ID NO: 51 - protein, 119 aa, Artificial Sequence
  Synthesized sequence with two or more selenocysteine residues substituted for two or more cysteine residues
  VARIANT (1)...(119): Xaa = selenocysteine or cysteine
QVTLKESGPVLVKPTETLTLTXTVSGFSLTNYHVQWIRQPPGKALEWLGVMWSDGDTSFNSVLKSRLTISRDTSKSQVVLTMTNMDPVDTATYYXARDGTIAAMDYFDYWGQGTLVTVS

SEQ ID NO: 52 - protein, 121 aa, Artificial Sequence
  Synthesized sequence with two or more selenocysteine residues substituted for two or more cysteine residues
  VARIANT (1)...(121): Xaa = selenocysteine or cysteine
EVQLVQSGGGLVQPKGSLKLSXAASGFNFNTYAMHWVRQAPGKGLEWIGRIRSKSHNYATDYADPVKDRFTISRDDSQGLLYLLMNNLKTEDTAMYYXMREGIYGSFAYWGQGTLVTVSAA

SEQ ID NO: 53 - protein, 129 aa, Artificial Sequence
  Synthesized sequence with two or more selenocysteine residues substituted for two or more cysteine residues
  VARIANT (1)...(129): Xaa = selenocysteine or cysteine
EVQLLESGGGLVQPGGSLRLSXAASGFTFSKYIMQWVRQAPGKGLEWVSGIRPSGGTTVYADSVKGRFTISRDNSKNTLYLQMNSLRAEDTAVYYXARALPRSGYLISPHYYYYALDVWGQGTTVTVSS

SEQ ID NO: 54 - protein, 117 aa, Artificial Sequence
  Synthesized sequence with two or more selenocysteine residues substituted for two or more cysteine residues
  VARIANT (1)...(117): Xaa = selenocysteine or cysteine
QVNLRESGGDLVKPGGSLRLSXAASGFTFRKYYMAWIRQAPGKGPEWLSTISNSGDIIDYADSVRGRFSISRDNAQKSLYLQMTSLRPDDSAIYYXAREYFFSFDVWGRGTMVTVSS

SEQ ID NO: 55 - protein, 120 aa, Artificial Sequence
  Synthesized sequence with two or more selenocysteine residues substituted for two or more cysteine residues
  VARIANT (1)...(120): Xaa = selenocysteine or cysteine
QVQLVESGGGVVQPGRSLRLSXTASGFRFRSHGMHWVRQAPGKGLEWVAVISYDGNNKLYADSVKGRITISRDNSKNTLFLQMNNVRAEDTAVYYXASPYTSDWQYFQYWGQGTLVIVSS

SEQ ID NO: 56 - protein, 118 aa, Artificial Sequence
  Synthesized sequence with two or more selenocysteine residues substituted for two or more cysteine residues
  VARIANT (1)...(118): Xaa = selenocysteine or cysteine
SEMKLEESGGGLVQPGGSMKLSXVASGFTFSNYWMNWVRQSPEKGLEWVAQIRLKSYNYATHYAESVKGRFTISRDDSKSSVYLQMNNLRAEDTGIYYXTPDGSDYWGQGTTLTVSSA

SEQ ID NO: 57 - protein, 120 aa, Artificial Sequence
  Synthesized sequence with two or more selenocysteine residues substituted for two or more cysteine residues
  VARIANT (1)...(120): Xaa = selenocysteine or cysteine
QVQLQQSGAELVRPGTSVKVSXKASGYAFTNNLIEWVKQRPGQGLEWIGVINPGSGDTNYNEKFKGKATLTADKSSNTAYMQLSSLTSDDSAVYFXARGDYYGGFAVDYWGQGTSVTVSS

SEQ ID NO: 58 - protein, 117 aa, Artificial Sequence
  Synthesized sequence with two or more selenocysteine residues substituted for two or more cysteine residues
  VARIANT (1)...(117): Xaa = selenocysteine or cysteine
DVQLQESGPGLVKPSQSLSLTXTVTGYSITSDYAWNWIRQFPGNKLEWMVYITYSGITGYNPSLKSRISITRDTSKNQFFLQLNSVTTGDTATYYXARYTTTAFDYWGQGTTLTVSS

SEQ ID NO: 59 - protein, 121 aa, Artificial Sequence
  Synthesized sequence with two or more selenocysteine residues substituted for two or more cysteine residues
  VARIANT (1)...(121): Xaa = selenocysteine or cysteine
ELKLEESGGGLVQPGGSMKLSXAASGFTFSDAWMDWVRQSPEKGLEWIAEIRSKANNYATYFAESVKGRFTISRDDSKSGVYLQMNNLRAEDTGIYFXTKLSLRYWFFDVWGAGTTVTVSS

SEQ ID NO: 60 - protein, 120 aa, Artificial Sequence
  Synthesized sequence with two or more selenocysteine residues substituted for two or more cysteine residues
  VARIANT (1)...(120): Xaa = selenocysteine or cysteine
EVQLVESGGGLVQPGGSLRLSXAASGFTFSSYAMSWVRQAPGKGLEWVSAISGSGGSTYYADSVKGRFTISRDNSKNTLYLQMNSLRAEDTAVYYXARYIDFGDHMDFWGQGTLVTVSSL

SEQ ID NO: 61 - protein, 121 aa, Artificial Sequence
  Synthesized sequence with two or more selenocysteine residues substituted for two or more cysteine residues
  VARIANT (1)...(121): Xaa = selenocysteine or cysteine
QVKLLEQSGAEVKKPGASVKVSXKASGFSIGNYGIHWVRQAPGQRLEWMGGIWSGGNADYAQKFQGRVTITRDTSATTAYMGLSSLRPEDTAVYYXARVGTYYDYEFDVWGQGTLVTVSSA

SEQ ID NO: 62 - protein, 120 aa, Artificial Sequence
  Synthesized sequence with two or more selenocysteine residues substituted for two or more cysteine residues
  VARIANT (1)...(120): Xaa = selenocysteine or cysteine
QVTLRESGPALVRPTQTLTLTXTFSGFSLNTSGMTVGWIRQPPGEALEWLAHIWWNDDKYYNPALKGRLAVSKDTSKNQVVLSMNTVGPGDTATYYXARMEDYDEAMDYWGQGILVTVSS

SEQ ID NO: 63 - protein, 119 aa, Artificial Sequence
  Synthesized sequence with two or more selenocysteine residues substituted for two or more cysteine residues
  VARIANT (1)...(119): Xaa = selenocysteine or cysteine
EVQLVESGGGLVQPGGSLRLSXAASGFTFSSYAVSWVRQAPGKGLEWVATISSGGSLTFYLDSVRGRFTISRDNSKNTLYLQMNSLRAEDTAVYYXARPIPDYYALDYWGQGTLVTVSS

SEQ ID NO: 64 - protein, 126 aa, Artificial Sequence
  Synthesized sequence with two or more selenocysteine residues substituted for two or more cysteine residues
  VARIANT (1)...(126): Xaa = selenocysteine or cysteine
QVQLVQSGAEVKKPGASVKVSXKASGYSFSSFGISWVRQAPGQGLEWLGWISAFNGYTKYAQKFQDRVTMTTDTSTSTAYMELRSLRSDDTAVYYXARDPAAWPLQQSLAWFDPWGQGTMVTVSSA

SEQ ID NO: 65 - protein, 122 aa, Artificial Sequence
  Synthesized sequence with two or more selenocysteine residues substituted for two or more cysteine residues
  VARIANT (1)...(122): Xaa = selenocysteine or cysteine
QVQLVQSGPEVKKPGASVKVSXTASGYTFTEYTMHWVRQAPGQGLEWMGGVNPYNDNTSYIRKLQGRVTLTVDRSSSTAYMELTSLTSDDTAVYYXARYGGLRPYYFPMDFWGQGTLVTVSS

SEQ ID NO: 66 - protein, 123 aa, Artificial Sequence
  Synthesized sequence with two or more selenocysteine residues substituted for two or more cysteine residues
  VARIANT (1)...(123): Xaa = selenocysteine or cysteine
EVQLLESGGGLVQPGGSLRLSXAASGFTFSNYIMWWVRQAPGKGLEWVSVISSSGGMTRYADSVKGRFTISRDNSKNTLYLQMNSLRAEDTAVYYXARDNGDYVGEKGFDIWGQGTMVTVSSA

SEQ ID NO: 67 - protein, 126 aa, Artificial Sequence
  Synthesized sequence with two or more selenocysteine residues substituted for two or more cysteine residues
  VARIANT (1)...(126): Xaa = selenocysteine or cysteine
QVQLVQSGAEVKKPGASVKVSXKASGYTFTSYGISWVRQAPGQGLEWMGWISAYNGNTNYAQKLQGRVTMTTDTSTSTAYMELRSLRSDDTAVYYXARDTPGIAARRYYYYGMDVWGQGTTVTVSS

SEQ ID NO: 68 - protein, 116 aa, Artificial Sequence
  Synthesized sequence with two or more selenocysteine residues substituted for two or more cysteine residues
  VARIANT (1)...(116): Xaa = selenocysteine or cysteine
EVQLLVSGGGLVQPGGSLRLSXAASGFTFKAYPMMWVRQAPGKGLEWVSEISPSGSYTYYADSVKGRFTISRDNSKNTLYLQMNSLRAEDTAVYYXAKDPRKLDYWGQGTLVTVSS

SEQ ID NO: 69 - protein, 120 aa, Artificial Sequence
  Synthesized sequence with two or more selenocysteine residues substituted for two or more cysteine residues
  VARIANT (1)...(120): Xaa = selenocysteine or cysteine
NVQLVESGGGLVQPGRSLRLSXTTSGFTFGDYAMIWARQAPGKGLEWVSSISSSSSYIYYADSVKGRFTISRDNAKNSLYLQMNSLRAEDTAVYYXARERYDFWSGMDVWGKGTTVTVSS

SEQ ID NO: 70 - protein, 117 aa, Artificial Sequence
  Synthesized sequence with two or more selenocysteine residues substituted for two or more cysteine residues
  VARIANT (1)...(117): Xaa = selenocysteine or cysteine
EVHLQQSGPELEKPGASVKISXKASGYSFTGYNMNVKQSNGKSLEWIGNIDPYYGDTDYDQKFKGTLTADKSSNTVYMQLQSLTSEDSAVYYXARGAHRDYYAMDYWGQGTSVTVSS

SEQ ID NO: 71 - protein, 124 aa, Artificial Sequence
  Synthesized sequence with two or more selenocysteine residues substituted for two or more cysteine residues
  VARIANT (1)...(124): Xaa = selenocysteine or cysteine
EFEVQLQESGPELVKPGASVKMSXKASGYTFTSYVMHWVKQKPGQGLEWIGYFNPYNDGTDYYEKFKGKATLTSDKSSSTAYMALSSLTSEDSAVYYXARGTYYYGSSYPFDYWGQGTTLTVSS

SEQ ID NO: 72 - protein, 117 aa, Artificial Sequence
  Synthesized sequence with two or more selenocysteine residues substituted for two or more cysteine residues
  VARIANT (1)...(117): Xaa = selenocysteine or cysteine
QVQLVQSGAEVKKPGASVKVSXTASGYTFTHYGMNWVRQAPGKGLEWMGWINTYTGEPTYADKFKDRFTFSLETSASTVYMELTSLTSDDTAVYYXARERGDAMDYWGQGTLVTVSS

SEQ ID NO: 73 - protein, 113 aa, Artificial Sequence
  Synthesized sequence with two or more selenocysteine residues substituted for two or more cysteine residues
  VARIANT (1)...(113): Xaa = selenocysteine or cysteine
QVQLQQSGAELAKPGASVKMSXKASGYTFTNYWMHWVKQRPGQGLEWIGYINPSNDYTKYNQKFKDKATLTADKSSNTAYMQLGSLTSEDSAVYYXARQGFPYWGQGTLVTVS

SEQ ID NO: 74 - protein, 120 aa, Artificial Sequence
  Synthesized sequence with two or more selenocysteine residues substituted for two or more cysteine residues
  VARIANT (1)...(120): Xaa = selenocysteine or cysteine
QSVKESEGGLFKPTDTLTLTXTVSGFSLSRYGINWVRQAPGSGLQWIGAIGETGRAYFASWAKSRSTITRNTNLNTVTLRMTSLTAADTATYFXARGELFNNGWGAFNIWGPGTLVTVSS

SEQ ID NO: 75 - protein, 121 aa, Artificial Sequence
  Synthesized sequence with two or more selenocysteine residues substituted for two or more cysteine residues
  VARIANT (1)...(121): Xaa = selenocysteine or cysteine
QVTLKESGPGILQPSQTLSLTXSFSGFSLSTSNMGVGWIRQPSGKGLEWLLHILWNDNKHYNPALKSRLTISDTYKNQVFLIANVDTADTATYYXARILYRSNYYVMDYWGQGTSVTVSSA

SEQ ID NO: 76 - protein, 114 aa, Artificial Sequence
  Synthesized sequence with two or more selenocysteine residues substituted for two or more cysteine residues
  VARIANT (1)...(114): Xaa = selenocysteine or cysteine
EVQLQQSGPDLVKPGASVKISXKASGYSFTGYYMHWVKQSHGKSLEWIGRVNPNNGGTSYNQKFKGKAILTVDKSSSTAYMELRSLTSEDSAVYYXATYAMDYWGQGTSVTVSS

SEQ ID NO: 77 - protein, 122 aa, Artificial Sequence
  Synthesized sequence with two or more selenocysteine residues substituted for two or more cysteine residues
  VARIANT (1)...(122): Xaa = selenocysteine or cysteine
QVSLKESGPGILQPSQTLSLTXSFSGFSLSTSGMGVSWIRQPSGKGLEWLAHIYWDDDKRYNPSLKSRLTISKDTSSNLVFLKITSVDTADTATYYXARREVRRDYYAMDYWGQGTSVTVSS

SEQ ID NO: 78 - protein, 118 aa, Artificial Sequence
  Synthesized sequence with two or more selenocysteine residues substituted for two or more cysteine residues
  VARIANT (1)...(118): Xaa = selenocysteine or cysteine
QVQLQQSGAELAKPGASVKMSXKASGYTFTTYWMHWVKQRPGQGLEWIGYINPNTDYTEYNQKFKDKATLTADKSSSTAFMQLSSLTSEDSAVYYXASSRDAYHGTYWGQGTLVTVSA

SEQ ID NO: 79 - protein, 121 aa, Artificial Sequence
  Synthesized sequence with two or more selenocysteine residues substituted for two or more cysteine residues
  VARIANT (1)...(121): Xaa = selenocysteine or cysteine
QVQLQQPGAELVRPGASVKLSXKASGYTFTTYWMNWVKQRPEQGLEWIGRIDPYDSETHYNQKFKDKAILTVDKSSSTAYMQLSSLTSEDSAVYYXARGPYYGTNPWFPYWGQGTLVTVSS

SEQ ID NO: 80 - protein, 117 aa, Artificial Sequence
  Synthesized sequence with two or more selenocysteine residues substituted for two or more cysteine residues
  VARIANT (1)...(117): Xaa = selenocysteine or cysteine
QVQLVESGGGLVQPGGSLRLSXAASGFTFSSYEMNWVRQAPGKGLEWVSYISSSGSTIYYADSVKGRFTISRDNSKNTLYLQMNSLRAEDTAVYYXASGDYMDVWGQGTTVTVSSSA

SEQ ID NO: 81 - protein, 105 aa, Artificial Sequence
  Synthesized sequence with two or more selenocysteine residues substituted for two or more cysteine residues
  VARIANT (1)...(105): Xaa = selenocysteine or cysteine
PGASVKLSXKASGYTFTTYWINWIKQRPGQGLEWIGRIAPGSGSTYYNEMFKSKATLTVDTSSSTAYIQLSSLSSEDSAVYFXARDGMGYYYGSRYWYFDVWGAG

SEQ ID NO: 82 - protein, 121 aa, Artificial Sequence
  Synthesized sequence with two or more selenocysteine residues substituted for two or more cysteine residues
  VARIANT (1)...(121): Xaa = selenocysteine or cysteine
QVQLVQSGAEVKKPGASVKVSXKASGYAFSNSWMNWVRQAPGQGLEWMGRIYPGDGDTKYNGKFKGRVTMTADTSTSTVYMELSSLRSEDTAVYYXARFLLISTVTAVDYWGQGTLVTVSS

SEQ ID NO: 83 - protein, 117 aa, Artificial Sequence
  Synthesized sequence with two or more selenocysteine residues substituted for two or more cysteine residues
  VARIANT (1)...(117): Xaa = selenocysteine or cysteine
QVQLVESGGGLVQPGGSLRLSXAASGFTFSSYWMNWVRQAPGKGLEWVSGIENKYAGGATYYAASVKGRFTISRDNSKNTLYLQMNSLRAEDTAVYYXARGFGTDFWGQGTLVTVSS

SEQ ID NO: 84 - protein, 115 aa, Artificial Sequence
  Synthesized sequence with two or more selenocysteine residues substituted for two or more cysteine residues
  VARIANT (1)...(115): Xaa = selenocysteine or cysteine
EVKLVESGGGLVQPGGSLKLSXAVSGFTFSDNGMAWVRQAPRKGPEWIAFISNLAYSIDYADTVTGRFTISRDNAKNTLYLEMSSLRSEDTAMYYXVSGTWFAYWGQGTLVTVSA

SEQ ID NO: 85 - protein, 120 aa, Artificial Sequence
  Synthesized sequence with two or more selenocysteine residues substituted for two or more cysteine residues
  VARIANT (1)...(120): Xaa = selenocysteine or cysteine
EVQLVESGGGLVQPGGSLRLSXAASGFTFLGYGIHWVRQAPGKGLEWVGWISPAGGSTDYADSVKGRFTISADTSKNTAYLQMNSLRAEDTAVYYXARGPFSPWVMDYWGQGTLVTVSSA

SEQ ID NO: 86 - protein, 121 aa, Artificial Sequence
  Synthesized sequence with two or more selenocysteine residues substituted for two or more cysteine residues
  VARIANT (1)...(121): Xaa = selenocysteine or cysteine
EVQLVESGGGLVQPGGSLRLSXAASGFSLTVYSVHWVRQAPGKGLEWVGALWGSGGTEYNSNLKSRFTISRDTSKNTVYLQMNSLRAEDTAVYYXARDQGLNYGSLFDYWGQGTLVTVSSA

SEQ ID NO: 87 - protein, 121 aa, Artificial Sequence
  Synthesized sequence with two or more selenocysteine residues substituted for two or more cysteine residues
  VARIANT (1)...(121): Xaa = selenocysteine or cysteine
EVQLVESGGGLVQPGGSLRLSXAASGFSLSGSWIHWVRQAPGKGLEWVGWINPYRGYAYYADSVKGRFTISADTSKNTAYLQMNSLRAEDTAVYYXAREYSGWGGSSVGYAMDYWGQGTLV

SEQ ID NO: 88 - protein, 120 aa, Artificial Sequence
  Synthesized sequence with two or more selenocysteine residues substituted for two or more cysteine residues
  VARIANT (1)...(120): Xaa = selenocysteine or cysteine
QVQLKESGPGLVKPSQSLSLTXSVTGFSITTGGYWWTWIRQFPGQKLEWMGYIFSSGNTNYNPSIKSRISITRDTSKNQFFLQLNSVTTEGDTARYYXARAYGKLGFDYWGQGTLVTVSS

SEQ ID NO: 89 - protein, 119 aa, Artificial Sequence
  Synthesized sequence with two or more selenocysteine residues substituted for two or more cysteine residues
  VARIANT (1)...(119): Xaa = selenocysteine or cysteine
DVQLQESGPGLVKPSQSLSLTXTVTGYSITSDYAWNWIRQFPGNKLEWMGYISYSGFTNYNPSLKSRISITRDTSKNQFFLQLSSVTTEDTATYFXEGGNYRYSWFPYWGQGTLVTVSA

SEQ ID NO: 90 - protein, 117 aa, Artificial Sequence
  Synthesized sequence with two or more selenocysteine residues substituted for two or more cysteine residues
  VARIANT (1)...(117): Xaa = selenocysteine or cysteine
EVQLVESGGGLVQPGGSLRLSXAASGYSFSSHYMHWVRQAPGKGLEWVGYIDPSNGETTYNQKFKGRFTISRDNSKNTLYLQMNSLRAEDTAVYYXAARGDYRYNGDWFFDVWGQGT

SEQ ID NO: 91 - protein, 122 aa, Artificial Sequence
  Synthesized sequence with two or more selenocysteine residues substituted for two or more cysteine residues
  VARIANT (1)...(122): Xaa = selenocysteine or cysteine
EVQLVESGGGLVQPGGSLKLSXAASGFTFSHYYMSWVRQTPEKRLEWVAYINSGGGRTDYPDSVKGRFTISRDNAKNTLHLQMSSLKSEDTAMYYXARLDYYGGSPYFDYWGQGTTLTVSSA

SEQ ID NO: 92 - protein, 120 aa, Artificial Sequence
  Synthesized sequence with two or more selenocysteine residues substituted for two or more cysteine residues
  VARIANT (1)...(120): Xaa = selenocysteine or cysteine
QVQLVQSGAEVKKPGSSVKVSXKASGYTFSSNVISWVRQAPGQGLEWMGGVIPIVDIANYAQRFKGRVTITADESTSTTYMELSSLRSEDTAVYYXASTLGLVLDAMDYWGQGTLVTVSS

SEQ ID NO: 93 - protein, 118 aa, Artificial Sequence
  Synthesized sequence with two or more selenocysteine residues substituted for two or more cysteine residues
  VARIANT (1)...(118): Xaa = selenocysteine or cysteine
EVKLVESGGGSVKPGGSLKVSXAASGFIFSNYGMSWVRQTPEKSLEWVASISRGGSTFYSDRVKGRFTISRENGRNILYLQMNSLRSEDTAIYYXVRYDYDEGATDYWGQGTTLTVSS

SEQ ID NO: 94 - protein, 122 aa, Artificial Sequence
  Synthesized sequence with two or more selenocysteine residues substituted for two or more cysteine residues
  VARIANT (1)...(122): Xaa = selenocysteine or cysteine
EVTLKESGPVLVKPTETLTLTXTVSGFSLSTYGMGVGWIRQPPGKALEWLAHIWWDDVKRYNPALKSRLTISKDTSKSQVVLTMTNMDPVDTATYYXARMGSDYDVWFDYWGQGTLVTVSSA

SEQ ID NO: 95 - protein, 121 aa, Artificial Sequence
  Synthesized sequence with two or more selenocysteine residues substituted for two or more cysteine residues
  VARIANT (1)...(121): Xaa = selenocysteine or cysteine
EVQLLESGGGLVQPGGSLRLSXAASGFTFSSYDMSWVRQAPGKGLEWVSGISYSGGSTYYADSVKGRFTISRDNSKNTLYLQMNSLRAEDTAVYYXAKGPFRMRFRSFDYWGQGTLVTVSS

SEQ ID NO: 96 - protein, 116 aa, Artificial Sequence
  Synthesized sequence with two or more selenocysteine residues substituted for two or more cysteine residues
  VARIANT (1)...(116): Xaa = selenocysteine or cysteine
VQLQQSGTVLARPGASVKMSXKASGYTFTSYWMHWVKQRPGQGLEWIGAIYPGNSDTSYNQKFKGKAKLTAVTSTSTAYMELSSLTNEDSAVYYXTRVYGRAMDYWGQGTSVTVSS

SEQ ID NO: 97 - protein, 120 aa, Artificial Sequence
  Synthesized sequence with two or more selenocysteine residues substituted for two or more cysteine residues
  VARIANT (1)...(120): Xaa = selenocysteine or cysteine
QVQLKESGPGLVAPSQSLSITXTVSGFSVTNYGVHWVRQPPGKGLEWLGVIWAGGITNYNSAFMSRLSISKDNSKSQVFLKMNSLQIDDTAMYYXASRGGHYGYALDYWGQGTSVTVSSA

SEQ ID NO: 98 - protein, 117 aa, Artificial Sequence
  Synthesized sequence with two or more selenocysteine residues substituted for two or more cysteine residues
  VARIANT (1)...(117): Xaa = selenocysteine or cysteine
QVQLVQSGAEVKKPGASVKVSXKASGYTFTNYNMHWVRQAPGQRLEWMGTIYPGNDDTSYNQKFKDRVTITADTSASTAYMELSSLRSEDTAVYYXARGGYRAMDYWGQGTLVTVSS

SEQ ID NO: 99 - protein, 117 aa, Artificial Sequence
  Synthesized sequence with two or more selenocysteine residues substituted for two or more cysteine residues
  VARIANT (1)...(117): Xaa = selenocysteine or cysteine
QVQLVESGGGVVQPGRSLRLSXTASGFTFSHYGMYWVRQAPGKGLEWVAVIWYDGSYEYNEDSVKGRFTISRDNSKNTLYLQMNSLRAEDTAVYYXARDRVGLFDYWGQGTLVTVSS

SEQ ID NO: 100 - protein, 120 aa, Artificial Sequence
  Synthesized sequence with two or more selenocysteine residues substituted for two or more cysteine residues
  VARIANT (1)...(120): Xaa = selenocysteine or cysteine
QVQLVQSGAEVKKPGSSVKVSXKASGGTFSSYAISWVRQAPGQGLEWMGRIIPILGIANYAQKFQGRVTITADKSTSTAYMELSSLRSEDTAVYYXARDMGSRNYYYFYWGQGTLVTVSS

SEQ ID NO: 101 - protein, 118 aa, Artificial Sequence
  Synthesized sequence with two or more selenocysteine residues substituted for two or more cysteine residues
  VARIANT (1)...(118): Xaa = selenocysteine or cysteine
QVQLQQPGAEVVKPGASVKMSXKASGYTFTSYYIHWIKQTPGQGLEWVGVIYPGNDDISYNQKFQGKATLTADKSSTTAYMQLSSLTSEDSAVYYXAREVRLRYFDVWGQGTTVTVSS

SEQ ID NO: 102 - protein, 121 aa, Artificial Sequence
  Synthesized sequence with two or more selenocysteine residues substituted for two or more cysteine residues
  VARIANT (1)...(121): Xaa = selenocysteine or cysteine
QVQLQQSGSELKKPGASVKVSXKASGFTFTNYGMNWVKQAPGQGLKWMGWINTYTREPTYADDFKGRFAFSLDTSVSTAYLQISSLKADDTAVYFXARDITAVVPTGFDYWGQGSLVTVSS

SEQ ID NO: 103 - protein, 120 aa, Artificial Sequence
  Synthesized sequence with two or more selenocysteine residues substituted for two or more cysteine residues
  VARIANT (1)...(120): Xaa = selenocysteine or cysteine
VQLQQSGAELKKPGASVKVSXKASGYTFTEYIIHWIKLRSGQGLEWIGWFYPGSNDIQYNAQFKGKATLTADKSSSTVYMELTGLTPEDSAVYFXARRDDFSGYDALPYWGQGTLVTVSA

SEQ ID NO: 104 - protein, 121 aa, Artificial Sequence
  Synthesized sequence with two or more selenocysteine residues substituted for two or more cysteine residues
  VARIANT (1)...(121): Xaa = selenocysteine or cysteine
EVKVVESGGGLVQPGGSLRLSXATSGFTFTDYYMSWVRQPPGKALEWLGFIRNRVSGYTTEYSASVQGRFTISRDNSQSILYLQMNTLRAEDSATYYXARDHYGNFAMDYWGQGTSVTVSS

SEQ ID NO: 105 - protein, 117 aa, Artificial Sequence
  Synthesized sequence with two or more selenocysteine residues substituted for two or more cysteine residues
  VARIANT (1)...(117): Xaa = selenocysteine or cysteine
EVQLVESGGGLVQPGGSLRLSXAVSGFSLTSHGVHWVRQAPGKGLEWLGVIWGAGRTDYNAAFISRLSISRDISKSQVYLQMNSLRAEDTAVYYXARNRYESYFDYWGQGTLVTVSS

SEQ ID NO: 106 - protein, 118 aa, Artificial Sequence
  Synthesized sequence with two or more selenocysteine residues substituted for two or more cysteine residues
  VARIANT (1)...(118): Xaa = selenocysteine or cysteine
KVQLQQSGTELVKPGASVKVSXKASGYIFTEYIIHWVKQRSGQGLEWIGWLYPESNIIKYNEKFKDKATLTADKSSSTVYMELSRLTSEDSAVYFXTRHDGTNFDYWGQGTTLTVSSA

SEQ ID NO: 107 - protein, 124 aa, Artificial Sequence
  Synthesized sequence with two or more selenocysteine residues substituted for two or more cysteine residues
  VARIANT (1)...(124): Xaa = selenocysteine or cysteine
QVQLQQSGAEVKKPGSSVKVSXKASGYAFSSYWMNWVRQRPGQGLEWIGQIWPGDGDTNYNGKFKGRATITADESTNTAYMELSSLRSEDTAFYSXARRETTTVGRYYYAMDYWGQGTTVTVSS

SEQ ID NO: 108 - protein, 121 aa, Artificial Sequence
  Synthesized sequence with two or more selenocysteine residues substituted for two or more cysteine residues
  VARIANT (1)...(121): Xaa = selenocysteine or cysteine
QVQLQESGGGVVQPGRSLRLSXSASGFTFSDYYMYWVRQAPGKGLEWVAYITNYGGSTYYPDTVKGRFTISRDNAKNTLFLQMDSLRPEDTGVYFXARQSNYDYDGWFAYWGQGTPVTVSS

SEQ ID NO: 109 - protein, 117 aa, Artificial Sequence
  Synthesized sequence with two or more selenocysteine residues substituted for two or more cysteine residues
  VARIANT (1)...(117): Xaa = selenocysteine or cysteine
QVQLQESGAELVRPGASVKLSXKASGYTFSISWINWVKQRPGQGLEWIGNIYPSGGYTNYNQKFKDKATLTVDKSSNTAYIQLSSPTSEDSAVYYXTRGYGHLDYWGQGTTLTVSAA

SEQ ID NO: 110 - protein, 123 aa, Artificial Sequence
  Synthesized sequence with two or more selenocysteine residues substituted for two or more cysteine residues
  VARIANT (1)...(123): Xaa = selenocysteine or cysteine
EVKLVNSGGGLVQPGNSLRLSXATSGFTFTDFYMSWVRQPPGKALEWLGFVRNRANGYTTEYSVSVKGRFIISRDNFQSTLFLQMNTLRAEDSGTYYXVRGPGDTADYTMDYWGQGTSVTVSS

SEQ ID NO: 111 - protein, 118 aa, Artificial Sequence
  Synthesized sequence with two or more selenocysteine residues substituted for two or more cysteine residues
  VARIANT (1)...(118): Xaa = selenocysteine or cysteine
QIQLVQSGPDLKKPGETVKISXKASGYTFTNYGINWVKQAPGKGFKWMGWIDTYTGEPTYVDDFKGRFVFSLETSASTAYLQINNLKNEDTATYFXVRKRAYDYEIYWGQGTPLTVSS

SEQ ID NO: 112 - protein, 108 aa, Artificial Sequence
  Synthesized sequence with two or more selenocysteine residues substituted for two or more cysteine residues
  VARIANT (1)...(108): Xaa = selenocysteine or cysteine
EVQLVQSGAEVKKPGESLKISXKGSGYSFTSYWISWVRQMPGKGLEWMGIIYPGDSYTRYSPSFQGQVTISADKSISTAYLQWSSLKASDTAMYYXARVPVSPAYLDY

SEQ ID NO: 113 - protein, 122 aa, Artificial Sequence
  Synthesized sequence with two or more selenocysteine residues substituted for two or more cysteine residues
  VARIANT (1)...(122): Xaa = selenocysteine or cysteine
QVQLVQSGAEVKKPGASVKVSXKASGYTFTTYGITWVRQAPGQGLEWMGEIFPGSGNTYYNEKFKGRVTITADKSTSTAYMELSSLRSEDTAVYYXARESFSDGYYGYFDYWGQGTLVTVSS

SEQ ID NO: 114 - protein, 127 aa, Artificial Sequence
  Synthesized sequence with two or more selenocysteine residues substituted for two or more cysteine residues
  VARIANT (1)...(127): Xaa = selenocysteine or cysteine
QVQLVESGGGVVQPGRSLRLSXAASGFTFSSYAMHWVRQAPGKGLEWVAVISYDGSNKYYADSVKGRFTISRDNSKNTLYLQMNSLRAEDTAVYYXARGIAAAGPPYYYYYYYMDVWGKGTTVTVSS

SEQ ID NO: 115 - protein, 121 aa, Artificial Sequence
  Synthesized sequence with two or more selenocysteine residues substituted for two or more cysteine residues
  VARIANT (1)...(121): Xaa = selenocysteine or cysteine
QVQLQEWGAGLLKPSETLSLTXAVSGGSLSGHYWSWVRLPPGKGLEWIGEISHSGNTNYNSSLKSRASISIDTSKNEYSLNLKSVTAVDTAVYYXARFYGDYPSSYGMDVWGQGTTVTVSS

SEQ ID NO: 116 - protein, 115 aa, Artificial Sequence
  Synthesized sequence with two or more selenocysteine residues substituted for two or more cysteine residues
  VARIANT (1)...(115): Xaa = selenocysteine or cysteine
EAQLQQSGAELVKPGASVKLSXTASGFNIQETYMHWVKQRPEQGLEWIGRIDPANGNTKDDPKFQGKASITVDTSSNTAYLQLSSLTSEDTAVYYXASSYAMDYWGQGTSVTVSS

SEQ ID NO: 117 - protein, 119 aa, Artificial Sequence
  Synthesized sequence with two or more selenocysteine residues substituted for two or more cysteine residues
  VARIANT (1)...(119): Xaa = selenocysteine or cysteine
QVQLVQSGAEVKKPGASVKVSXKVSGKTFWSYGINWVRQAPGKGLEWMGYIYIGTGYTEPNPKYKGRVTMTEDTSTDTAYMELSSLRSEDTAVYYXATIGGYYGNFDQWGQGTTVTVSS

SEQ ID NO: 118 - protein, 120 aa, Artificial Sequence
  Synthesized sequence with two or more selenocysteine residues substituted for two or more cysteine residues
  VARIANT (1)...(120): Xaa = selenocysteine or cysteine
QDQLVESGGGVVQPGRSLRLSXAASGFTFSSYGMHWVRQAPGEGLEWVAVIWYDGSNKYYADSVKGRFTISRDNSKNTLYLQMNSLRAEDTAVYYXARGDYEVDYGMDVWGQGTTVTVAS

SEQ ID NO: 119 - protein, 116 aa, Artificial Sequence
  Synthesized sequence with two or more selenocysteine residues substituted for two or more cysteine residues
  VARIANT (1)...(116): Xaa = selenocysteine or cysteine
EVQLVQSGAEVKKPGASVKVSXKVSGYTFTDYYMHWVQQAPGKGLEWMGLVDPEDGETIYAEKFQGRVTITADTSTDTAYMELSSLRSEDTAVYYXARDDYMDVWGKGTLVTVSSA

SEQ ID NO: 120 - protein, 114 aa, Artificial Sequence
  Synthesized sequence with two or more selenocysteine residues substituted for two or more cysteine residues
  VARIANT (1)...(114): Xaa = selenocysteine or cysteine
QVQLVQSGSELKKPGASVKVSXKASGYTFTDYSMRWVRQAPGQGLEWMGWINTETGSPTYADDFKGRFVFSLDTSVSTAYLQISSLKAEDTAVYYXARGFAYWGQGTLVTVSSA

SEQ ID NO: 121 - protein, 122 aa, Artificial Sequence
  Synthesized sequence with two or more selenocysteine residues substituted for two or more cysteine residues
  VARIANT (1)...(122): Xaa = selenocysteine or cysteine
EVTLKESGPVLVKPTETLTLTXTVSGFSLSTYGVGVGWIRQPPGKALEWLAHIWWDDVKRYNPALKSRLTISKDTSKSQVVLTMTNMDPVDTATYYXARLGSDYDVWFDYWGQGTLVTVSSA

SEQ ID NO: 122 - protein, 119 aa, Artificial Sequence
  Synthesized sequence with two or more selenocysteine residues substituted for two or more cysteine residues
  VARIANT (1)...(119): Xaa = selenocysteine or cysteine
EVQLLESGGGLVQPGGSLRLSXAASGFTFSDYYMYWVRQAPEKRLEWVAYISNGGGSSHYVDSVKGRFTISRDNAKNTLYLQMNSLRAEDTALYHXARGMDYGAWFAYWGQGTLVTVSS

SEQ ID NO: 123 - protein, 118 aa, Artificial Sequence
  Synthesized sequence with two or more selenocysteine residues substituted for two or more cysteine residues
  VARIANT (1)...(118): Xaa = selenocysteine or cysteine
QVQLQESGPGLVKPSQTLSLTXTVSDYSITSDYAWNWIRQFPGKGLEWMGYISYSGSTSYNPSLKSRITISRDTSKNQFSLQLNSVTAADTAVYYXASFDYAHAMDYWGQGTTVTVSS

SEQ ID NO: 124 - protein, 123 aa, Artificial Sequence
  Synthesized sequence with two or more selenocysteine residues substituted for two or more cysteine residues
  VARIANT (1)...(123): Xaa = selenocysteine or cysteine
QVQLVESGGGVVQPGRSLRLSXAASGFTFTNYGMHWVRQAPGKGLEWVAVISHDGNNKYYVDSVKGRFTISRDNSKNTLYLQMNSLRAEDTAVYYXAREGIDFWSGLNWFDPWGQGTLVTVSS

SEQ ID NO: 125 - protein, 129 aa, Artificial Sequence
  Synthesized sequence with two or more selenocysteine residues substituted for two or more cysteine residues
  VARIANT (1)...(129): Xaa = selenocysteine or cysteine
EVQLLESGGGLVQPGGSLRLSXAASGFTFSHYMMAWVRQAPGKGLEWVSRIGPSGGPTHYADSVKGRFTISRDNSKNTLYLQMNSLRAEDTAVYYXAGYDSGYDYVAVAGPAEYFQHWGQGTLVTVSSA

SEQ ID NO: 126 - protein, 125 aa, Artificial Sequence
  Synthesized sequence with two or more selenocysteine residues substituted for two or more cysteine residues
  VARIANT (1)...(125): Xaa = selenocysteine or cysteine
QVQLVQSGAEVKKPGASVKVSXKASGYTFTGYYMHWVRQAPGQGLEWMGWINPHSGGTNYAQKFQGRVTMTRDTSISTAYMELSRLRSDDTAVYYXARTYYYDSSGYYHDAFDIWGQGTMVTVSS

SEQ ID NO: 127 - protein, 116 aa, Artificial Sequence
  Synthesized sequence with two or more selenocysteine residues substituted for two or more cysteine residues
  VARIANT (1)...(116): Xaa = selenocysteine or cysteine
QVQLVQSGAEVKKPGASVKVSXKASGYAFTSYYMHWVRQAPGQGLEWMGIINPRGGSTSYAQKFQGRVTMTRDTSTSTVYMELSSLRSEDTAVYYXARGKYWMYDWGKGTLVTVSS

SEQ ID NO: 128 - protein, 113 aa, Artificial Sequence
  Synthesized sequence with two or more selenocysteine residues substituted for two or more cysteine residues
  VARIANT (1)...(113): Xaa = selenocysteine or cysteine
EVQLVESGGGLVQPGGSLRLSXAASGYTFSDYYLYWVRQAPGKGLEWVGGISPSSGGTTFADAFEGRFTISVDKSKNTAYLQMNSLRAEDTAVYYXTRDAYGDWYFDVWGQGT

SEQ ID NO: 129 - protein, 115 aa, Artificial Sequence
  Synthesized sequence with two or more selenocysteine residues substituted for two or more cysteine residues
  VARIANT (1)...(115): Xaa = selenocysteine or cysteine
EVQLVQSGPEVKKPGATVKISXKTSGYTFTEYTIHWVKQAPGKGLEWIGNINPNNGGTTYNQKFEDKATLTVDKSTDTAYMELSSLRSEDTAVYYXAAGWNFDYWGQGTLLTVSS

SEQ ID NO: 130 - protein, 119 aa, Artificial Sequence
  Synthesized sequence with two or more selenocysteine residues substituted for two or more cysteine residues
  VARIANT (1)...(119): Xaa = selenocysteine or cysteine
EVQLLESGGGLVQPGGSLRLSXAASGFTFSHYVMAWVRQAPGKGLEWVSSISSSGGWTLYADSVKGRFTISRDNSKNTLYLQMNSLRAEDTAVYYXTRGLKMATIFDYWGQGTLVTVSS

SEQ ID NO: 131 - protein, 120 aa, Artificial Sequence
  Synthesized sequence with two or more selenocysteine residues substituted for two or more cysteine residues
  VARIANT (1)...(120): Xaa = selenocysteine or cysteine
EVQLVESGGGLVQPGGSLRLSXAASGFTFSSYAMSWVRQAPGKGLEWVSYISDDGSLKYYADSVKGRFTISRDNSKNTLYLQMNSLRAEDTAVYYXARHPYWYGGQLDLWGQGTLVTVSS

SEQ ID NO: 132 - protein, 120 aa, Artificial Sequence
  Synthesized sequence with two or more selenocysteine residues substituted for two or more cysteine residues
  VARIANT (1)...(120): Xaa = selenocysteine or cysteine
QVQLVESGGGLVQPGGSLRLSXAASGFTFSSYYMNWVRQAPGKGLEWVSGISGDPSNTYYADSVKGRFTISRDNSKNTLYLQMNSLRAEDTAVYYXARDLPLVYTGFAYWGQGTLVTVSS

SEQ ID NO: 133 - protein, 122 aa, Artificial Sequence
  Synthesized sequence with two or more selenocysteine residues substituted for two or more cysteine residues
  VARIANT (1)...(122): Xaa = selenocysteine or cysteine
EVQLVESGGGSVQPGESLRLSXVASGFTFSRYKMNWVRQAPGKGLEWVSYISRSGRDIYYADSVKGRFTISRDNAKNSLYLQMNSLRDEDTAVYYXAGTVTTYYYDFGMDVWGQGTTVTVSS

SEQ ID NO: 134 - protein, 119 aa, Artificial Sequence
  Synthesized sequence with two or more selenocysteine residues substituted for two or more cysteine residues
  VARIANT (1)...(119): Xaa = selenocysteine or cysteine
EVQLVESGGGLVQPGGSLRLSXAFSGFTLSTSGMGIGWVRQAPGKGLEWVAHWWDDDKYYNPSLKSRFTISRDTSKNTVYLQMNSLRAEDTAVYYXARNYYPYDAWFDYWGQGTLVTVS

SEQ ID NO: 135 - protein, 129 aa, Artificial Sequence
  Synthesized sequence with two or more selenocysteine residues substituted for two or more cysteine residues
  VARIANT (1)...(129): Xaa = selenocysteine or cysteine
QVQLVESGGGVVQPGKSLRLSXAASGFTFSSYGMYWVRQAPGKGLEWVAVISYDGSNKYYADSVKGRFTISRDNSKNTLYLQMNSLRAEDTAVYNXAKEMRYGSGRKAIKYYYGMDVWGQGTTVTVSSA

SEQ ID NO: 136 - protein, 115 aa, Artificial Sequence
  Synthesized sequence with two or more selenocysteine residues substituted for two or more cysteine residues
  VARIANT (1)...(115): Xaa = selenocysteine or cysteine
QLQLQESGPGLVKPSETLSLTXAVSGASISNWWSWVRQPPGKGLEWIGEVHHSGVTTYKPSLKSRVTISVDNSKNQLSKLTSVTAADTAVYYXAREFADDAFDIWGRGTMVTVSS

SEQ ID NO: 137 - protein, 117 aa, Artificial Sequence
  Synthesized sequence with two or more selenocysteine residues substituted for two or more cysteine residues
  VARIANT (1)...(117): Xaa = selenocysteine or cysteine
EVQLVESGGGLVQPGGSLRLSXAASGFTFSSFGMHWVRQAPGKGLEWVAYISRGSSTIYYADTVKGRFTISRDNAKNSLYLQMNSLRAEDTAVYYXARGITTALDYWGQGTLVTVSS

SEQ ID NO: 138 - protein, 119 aa, Artificial Sequence
  Synthesized sequence with two or more selenocysteine residues substituted for two or more cysteine residues
  VARIANT (1)...(119): Xaa = selenocysteine or cysteine
EVKFEESGGGLVQPGGSMKLSXVASGFSFSNYWMNWVRQSPEKGLEWVAEIRLTSNKQAIYYAESVKGRFTISRDDSKSSVYLQMNNLRAEDTGIYYXASLFYDGYLHWGQGTLVTVSA

SEQ ID NO: 139 - protein, 131 aa, Artificial Sequence
  Synthesized sequence with two or more selenocysteine residues substituted for two or more cysteine residues
  VARIANT (1)...(131): Xaa = selenocysteine or cysteine
QVQLVQSGAEVKKPGSSVKVSXKASGGTFNSHAISWVRQAPGQGLEWMGGINPILGIANYAQKFQGRVTITADESTSTAYMELSSLRSEDTAVYYXARHYEIQIGRYGMNVYYLMYRFASWGQGTLVTVSS

SEQ ID NO: 140 - protein, 125 aa, Artificial Sequence
  Synthesized sequence with two or more selenocysteine residues substituted for two or more cysteine residues
  VARIANT (1)...(125): Xaa = selenocysteine or cysteine
QVQLQQSGPGLVKPSQTLSLTXAISGDSVSSNSAAWNWIRQSPSRGLEWLGRTYYRSKWYNDYAVSVKSRITINPDTSKNQFSLQLNSVTPEDTAVYYXAREVTGDLEDAFDIWGQGTMVTVSSA

SEQ ID NO: 141 - protein, 118 aa, Artificial Sequence
  Synthesized sequence with two or more selenocysteine residues substituted for two or more cysteine residues
  VARIANT (1)...(118): Xaa = selenocysteine or cysteine
EVQLVQSGGGVVRPGGSLRLPXAASGFTFDDYGMSWVRQAPGKGLEWVSGINWNGGSTGYADSVKGRFTISRDNAKNSLYLQMNSLRAEDTALYHXARGGDDAFDIWGQGTMVTVSSA

SEQ ID NO: 142 - protein, 119 aa, Artificial Sequence
  Synthesized sequence with two or more selenocysteine residues substituted for two or more cysteine residues
  VARIANT (1)...(119): Xaa = selenocysteine or cysteine
QVQLVQSGAEVKKPGASVKVSXKVSGYTLTEFAMHWVRQAPGKGLEWMGGFVPEDGETIYAQKFQGRVTMTEDTSTDTAYMELSSLRSEDTAVYYXATDPLYTPGLEPWGQGTTVTVSS

SEQ ID NO: 143 - protein, 119 aa, Artificial Sequence
  Synthesized sequence with two or more selenocysteine residues substituted for two or more cysteine residues
  VARIANT (1)...(119): Xaa = selenocysteine or cysteine
EVQLVQSGAEVKKPGATVKISXKVSGYTFTDYSMHWVRQAPGKGLKWMGWINTETGEPIYADDFKGRFTFTLDTSTSTAYMELSSLRSEDTAVYYXARNYDYDGYFDVWGQGTTVTVSS

SEQ ID NO: 144 - protein, 119 aa, Artificial Sequence
  Synthesized sequence with two or more selenocysteine residues substituted for two or more cysteine residues
  VARIANT (1)...(119): Xaa = selenocysteine or cysteine
QVQLVQSGAEVKRPGASVQVSXRASGYSINTYYMQWVRQAPGAGLEWMGVINPSGVTSYAQKFQGRVTLTNDTSTNTVYMQLNSLTSADTAVYYXARWALWGDFGMDVWGKGTLVTVSS

SEQ ID NO: 145 - protein, 118 aa, Artificial Sequence
  Synthesized sequence with two or more selenocysteine residues substituted for two or more cysteine residues
  VARIANT (1)...(118): Xaa = selenocysteine or cysteine
QVQLQESGPGILKPSQTLSLTXSFSGFSLSTSGMGVGWIRQPSGKGLERLAHIWWDDDKYYNPSLKSQLTISKDTSRNQVFLKIISVDTADTATYYXARKDYGSSYDYWGQGTTVTVS

SEQ ID NO: 146 - protein, 119 aa, Artificial Sequence
  Synthesized sequence with two or more selenocysteine residues substituted for two or more cysteine residues
  VARIANT (1)...(119): Xaa = selenocysteine or cysteine
EVKLLESGGGLVQPGGSLKLSXVVSGFDFRRNWMSWVRQAPGKGLEWIGEINPDSSKINYTPSLKDKFIISRDNAKNTLYLQVSTVRSEDTALYYXVRPVWMYAMDYWGQGTSVTVSSA

SEQ ID NO: 147 - protein, 118 aa, Artificial Sequence
  Synthesized sequence with two or more selenocysteine residues substituted for two or more cysteine residues
  VARIANT (1)...(118): Xaa = selenocysteine or cysteine
EVQLVESGAEVKKPGASVKVSXKASGYTFTNYIIHWVKQEPGQGLEWIGYFNPYNHGTKYNEKFKGRATLTADKSISTAYMELSSLRSEDTAVYYXARSGPYAWFDTWGQGTTVTVSS

SEQ ID NO: 148 - protein, 119 aa, Artificial Sequence
  Synthesized sequence with two or more selenocysteine residues substituted for two or more cysteine residues
  VARIANT (1)...(119): Xaa = selenocysteine or cysteine
QVQLQQSAPELARPGASVKMSXTASGYIFTNYPIHWVKQRPGQGLEWIGFIDPGGGYDEPDERFRDRATLTADKSSSTAYMQLSSLTSEDSAIYYXARRGGGYYLDYWGQGTTLTVSSA

SEQ ID NO: 149 - protein, 117 aa, Artificial Sequence
  Synthesized sequence with two or more selenocysteine residues substituted for two or more cysteine residues
  VARIANT (1)...(117): Xaa = selenocysteine or cysteine
QIQFVQSGPELKKPGETVKISXKASGYTFTNYGMNWVKQAPGKGLKWMGWINSYTGEPTYADDFKGRFAFSLETSASTAYLQINNLKNEDTATYFXARGASYAMDYWGQGTSVTVSS

SEQ ID NO: 150 - protein, 115 aa, Artificial Sequence
  Synthesized sequence with two or more selenocysteine residues substituted for two or more cysteine residues
  VARIANT (1)...(115): Xaa = selenocysteine or cysteine
QVHLQESGPGLVKPSETLSLTXTVSDDSISSYYWSWIRQPPGKGLEWIGHISYSGSANYNPSLKSRVTISVDTSKNQFSLKLSSVTAADTAVYYXANWDDAFNIWGQGTMVTVSS

SEQ ID NO: 151 - protein, 116 aa, Artificial Sequence
  Synthesized sequence with two or more selenocysteine residues substituted for two or more cysteine residues
  VARIANT (1)...(116): Xaa = selenocysteine or cysteine
QVQLEESGPGLVAPSQSLSITXTVSGFSLTGYGIYWVRQPPGKGLEWLGMIWGDGRTDYNSALKSRLSISKDNSKSQVFLKMNSLQTDDTARYYXARDYYGSKDYWGQGTTLTVSS

SEQ ID NO: 152 - protein, 121 aa, Artificial Sequence
  Synthesized sequence with two or more selenocysteine residues substituted for two or more cysteine residues
  VARIANT (1)...(121): Xaa = selenocysteine or cysteine
QVQLQQSGAELMKPGASVKMSXKAAGYTFSSYWIEWVRQRPGHGLEWIGEIFPGSDSTNYNEKFNDRATFTADTSSNTAYMQLSSLTSEDSAVYYXARPLYYGSSAWFAYWGQGTLVTVSA

SEQ ID NO: 153 - protein, 122 aa, Artificial Sequence
  Synthesized sequence with two or more selenocysteine residues substituted for two or more cysteine residues
  VARIANT (1)...(122): Xaa = selenocysteine or cysteine
QVQLVESGGGVVQPGRSLRLSXAASGFTFSRYGMHWVRQAPGKGLEWVAVISYDGSNKWYADSVKGRFTISRDNSKNTLFLQMHSLRAADTGVYYXAKDQLYFGSQSPGHYWVQGTLVTVSS

SEQ ID NO: 154 - protein, 118 aa, Artificial Sequence
  Synthesized sequence with two or more selenocysteine residues substituted for two or more cysteine residues
  VARIANT (1)...(118): Xaa = selenocysteine or cysteine
EVQLVESGGGLVKPGGSLKLSXAASGFTFSSYAMSWARQTPEKRLEWVATISSGGSYTYYPDSVRGRFTISRDNAKNTLYLQMXSLRSEDTAMYYXARFDGYYAMDYWGQGTSVTVSS

SEQ ID NO: 155 - protein, 111 aa, Artificial Sequence
  Synthesized sequence with two or more selenocysteine residues substituted for two or more cysteine residues
  VARIANT (1)...(111): Xaa = selenocysteine or cysteine
EVQLQQSGSELVKPGASVKMSXKASGYTFTDYFMKWVKQSHGKSLEWIGDINPNNGDTFYIQKFKGKATLTVDKSSSTAYMQLNSLTSEDSAVYYXSRDLAYWGQGTLVAV

SEQ ID NO: 156 - protein, 117 aa, Artificial Sequence
  Synthesized sequence with two or more selenocysteine residues substituted for two or more cysteine residues
  VARIANT (1)...(117): Xaa = selenocysteine or cysteine
EVRLQQSGADLVKPGASVKLSXTASGFIIKATYMHWVRQRPEQGLEWIGRIDPANGETKYDPKFQVKATITADTSSSTAYLQLNSLTSDDTAVYYXARYAWYFDVWGAGTTVTVSSA

SEQ ID NO: 157 - protein, 123 aa, Artificial Sequence
  Synthesized sequence with two or more selenocysteine residues substituted for two or more cysteine residues
  VARIANT (1)...(123): Xaa = selenocysteine or cysteine
QVQLQQPGAELVKPGASVKLSXKASGYTFTNYWMYWVKQRPGQGLEWIGMIHPNSGSTNYNGKFKTGATLTVDKSSSTVYMQLSSLTSEDSAVYYXARWGYGGNYDYAMDYWGQGTSVTVSSA

SEQ ID NO: 158 - protein, 110 aa, Artificial Sequence
  Synthesized sequence with two or more selenocysteine residues substituted for two or more cysteine residues
  VARIANT (1)...(110): Xaa = selenocysteine or cysteine
QVQLVESGGGVVQPGRSLRLSXAASGFTFSSYAMHWVRQAPGKGLEWVAVISYDGSNKYYADSVKGRFTISRDNSKNTLYLQMNSLRAEDTAVYYXARDRLAVAGRPFDY

SEQ ID NO: 159 - protein, 119 aa, Artificial Sequence
  Synthesized sequence with two or more selenocysteine residues substituted for two or more cysteine residues
  VARIANT (1)...(119): Xaa = selenocysteine or cysteine
QVQLQQSGAELMKPGASVKISXKATGYKFSSYWIEWVKQRPGHGLEWIGEILPGSDTTNYNEKFKDKATFTSDTSSNTAYMQLSSLTSEDSAVYYXARDRGNYRAWFGYWGQGTLVTVS

SEQ ID NO: 160 - protein, 117 aa, Artificial Sequence
  Synthesized sequence with two or more selenocysteine residues substituted for two or more cysteine residues
  VARIANT (1)...(117): Xaa = selenocysteine or cysteine
EVQLLESGGGLVQPGGSLRLSXAASGFTFSSYAMSWVRQAPGKGLEWVSAISGSGGSTYYADSVKGRFTISRDNSKNTLYLQMNSLRAEDTAVYYXAKWGDGTLNPWGQGTMVTVSS

SEQ ID NO: 161 - protein, 116 aa, Artificial Sequence
  Synthesized sequence with two or more selenocysteine residues substituted for two or more cysteine residues
  VARIANT (1)...(116): Xaa = selenocysteine or cysteine
EVQLVESGGGLVQPGGSLRLSXAASGFTFSNYGMSWVRQAPGKGLEWVASISSGGGSTYYPDNVKGRFTISRDNAKNSLYLQMNSLRAEDTAVYYXARGGAGIDYWGQGTLVTVSS

SEQ ID NO: 162 - protein, 119 aa, Artificial Sequence
  Synthesized sequence with two or more selenocysteine residues substituted for two or more cysteine residues
  VARIANT (1)...(119): Xaa = selenocysteine or cysteine
EVQLVESGGGLVQPGGSLRLSXAASGYTFTNFGMNWVRQAPGKGLEWVAWINTNTGEPRYAEEFKGRFTISRDNAKNSLYLQMNSLRAEDTAVYYXARDWDGAYFFDYWGQGTLVTVSS

SEQ ID NO: 163 - protein, 121 aa, Artificial Sequence
  Synthesized sequence with two or more selenocysteine residues substituted for two or more cysteine residues
  VARIANT (1)...(121): Xaa = selenocysteine or cysteine
QVQLQQSGAELMKPGASVKISXKATGYTFSNYWMEWVKQRPGHGLEWIGEILPGRGRTNYNENFKGKATFTADTSSNTVYMQLNSLTSEDSAVYYXARFHSSAYYYTMDYWGQRTSVTVSS

SEQ ID NO: 164 - protein, 123 aa, Artificial Sequence
  Synthesized sequence with two or more selenocysteine residues substituted for two or more cysteine residues
  VARIANT (1)...(123): Xaa = selenocysteine or cysteine
QVQLQQPGSVVVRPGASVKLSXKASGYTFTSSWMHWAKQRPGQGLEWIGQIHPNSGNTNYNEKFKVKATLTIDTSSSTAYVDLNSLTSGDSAVYYXARGDDAYYSGLYAMDYWGQGTSVTVSS

SEQ ID NO: 165 - protein, 117 aa, Artificial Sequence
  Synthesized sequence with two or more selenocysteine residues substituted for two or more cysteine residues
  VARIANT (1)...(117): Xaa = selenocysteine or cysteine
QVQLQESGPGLVKPSETLSLTXTVSGYSITGGYLWNWIRQPPGKGLEWIGYISYDGTNNYKPSLKDRVTISRDTSKNQFSLKLSSVTAADTAVYYXARYGRVFFDYWGQGTLVTVSS

SEQ ID NO: 166 - protein, 114 aa, Artificial Sequence
  Synthesized sequence with two or more selenocysteine residues substituted for two or more cysteine residues
  VARIANT (1)...(114): Xaa = selenocysteine or cysteine
QVQLQQSGGGVVQPGRSLGLSXAASGFTFSSYGMNWVRQAPGKGLEWVSYISSSSSTIYYADSVKGRFTISRDNSKNTLYLQMNSLRAEDTAVYYXARGPGMDVWGQGTTVTVS

SEQ ID NO: 167 - protein, 117 aa, Artificial Sequence
  Synthesized sequence with two or more selenocysteine residues substituted for two or more cysteine residues
  VARIANT (1)...(117): Xaa = selenocysteine or cysteine
QVQLVQSGGGLVKPGGSLRLSXAASGFTFSSYSMNWVRQAPGKGLEWVANIKPDGSERHSVDSVKGRFTISRDNSKNSLYLQMNSLRAEDTAVYYXARPGAGRLDYWGQGTLVTVSS

SEQ ID NO: 168 - protein, 128 aa, Artificial Sequence
  Synthesized sequence with two or more selenocysteine residues substituted for two or more cysteine residues
  VARIANT (1)...(128): Xaa = selenocysteine or cysteine
EVQLVESGGGLVQPGGSLRLSXAASGFTFTSTGISWVRQAPGKGLEWVGRIYPTNGSTNYADSVKGRFTISADTSKNTAYLQMNSLRAEDTAVYYXARTYGIYDLYVDYTEYVMDYWGQGTLVTVSSA

SEQ ID NO: 169 - protein, 119 aa, Artificial Sequence
  Synthesized sequence with two or more selenocysteine residues substituted for two or more cysteine residues
  VARIANT (1)...(119): Xaa = selenocysteine or cysteine
QVQLQESGPGLVKPSETLSLTXAVSGYSIRSGYWWSWIRQPPGKGLEWIGQIYNKGNTDNNPALKSRVTISVDTSKNQFSLKLSSVTAADTAVYYXARVFWDDAYFDVWGQGTMVTVSS

SEQ ID NO: 170 - protein, 116 aa, Artificial Sequence
  Synthesized sequence with two or more selenocysteine residues substituted for two or more cysteine residues
  VARIANT (1)...(116): Xaa = selenocysteine or cysteine
EVQLLESGGGLVQPGGSLRLSXAASGFTFSSFAMSWVRQAPGKGLEWVSGISGSGGGTHYADSVKGRFTISRDNSKNMVYLQMNSLRAEDTAAYYXAKEAYKWQPWGQGTLVTVSS

SEQ ID NO: 171 - protein, 126 aa, Artificial Sequence
  Synthesized sequence with two or more selenocysteine residues substituted for two or more cysteine residues
  VARIANT (1)...(126): Xaa = selenocysteine or cysteine
EEQLVESGGDLVQPGRSLRLSXAASGFTFHDYTMHWVRQAPGKGLEWVSGISWNSGSLGYADSVKGRFTISRDNAKKSLYLQMNSLRAEDTALYYXAKDPSYGSGSYHSYYGMDVWGQGTTVTVSS

SEQ ID NO: 172 - protein, 118 aa, Artificial Sequence
  Synthesized sequence with two or more selenocysteine residues substituted for two or more cysteine residues
  VARIANT (1)...(118): Xaa = selenocysteine or cysteine
EVQLLESGGGLVHPGGSLRLSXAASGFTFGGYAMSWVRQAPGKGLEWVSLISGSGGSTYYADSVKGRFTIFRDNSKNTLYLQMISLRAEDSAVYYXAKYSNYDYFDPWGQGTLVTVSS

SEQ ID NO: 173 - protein, 120 aa, Artificial Sequence
  Synthesized sequence with two or more selenocysteine residues substituted for two or more cysteine residues
  VARIANT (1)...(120): Xaa = selenocysteine or cysteine
QVQLQESGPGLVKPSQTLSLTXTVSGGSISSGDYYWNWIRQYPGKGLELIGYIYYSGITYYNPSLKSRLTISLDTSKNQFSLKLSSVTAADTAVYYXARDRVELRAFDIWGQGTMVTVSS

SEQ ID NO: 174 - protein, 119 aa, Artificial Sequence
  Synthesized sequence with two or more selenocysteine residues substituted for two or more cysteine residues
  VARIANT (1)...(119): Xaa = selenocysteine or cysteine
QVQLVESGGGVVQPGRSLRLSXVASGFTFSRYGIHWVRQAPGKGLEWVIVISYDGINKYYADSVKGRFTISRDNSKNTVYLQMNSLRAEDTAVYYXAKGDFWSGYFDYWGQGTLVTVSS

SEQ ID NO: 175 - protein, 129 aa, Artificial Sequence
  Synthesized sequence with two or more selenocysteine residues substituted for two or more cysteine residues
  VARIANT (1)...(129): Xaa = selenocysteine or cysteine
QVQLVESGAEVKKPGASVKVSXKASGYTFTGYYMHWVRQAPGQGLEWMGWINPNSGGTNYAQKFQGRVTMTRDTSISTAYMELSRLRSDDTAVYYXARSPNPYYYDSSGYYYPGAFDIWGQGTMVTVSS

SEQ ID NO: 176 - protein, 117 aa, Artificial Sequence
  Synthesized sequence with two or more selenocysteine residues substituted for two or more cysteine residues
  VARIANT (1)...(117): Xaa = selenocysteine or cysteine
QVQLVESGGGLVQPGGSLRLSXAASGFTFSNYWVNWVRQAPGKGLEWVSLISYDGSNTHYADSVKGRFTISRDNSKNTLYLQMNSLRAEDTAVYYXARGRFYNFDYWGQGTLVTVSS

SEQ ID NO: 177 - protein, 115 aa, Artificial Sequence
  Synthesized sequence with two or more selenocysteine residues substituted for two or more cysteine residues
  VARIANT (1)...(115): Xaa = selenocysteine or cysteine
QVQLQQSGPELVRPGVSVKISXKGSGYTFTDYAMHWVKQSHAKSLEWIGVISTKYGKTNYNQKFKGKATMTVDKSSSTAYMELARLTSEDSAIYYXARGDDGYSWGQGTSVTVSS

SEQ ID NO: 178 - protein, 117 aa, Artificial Sequence
  Synthesized sequence with two or more selenocysteine residues substituted for two or more cysteine residues
  VARIANT (1)...(117): Xaa = selenocysteine or cysteine
EVKLVESGGGLVQPGGSLRLSXATSGFTFTDYYMSWVRQPPGKALEWLGFIRNKANGYTTEYSASVKGRFTISRDNSQSILYLQMDTLRAEDSATYYXARDNWFAYWGQGTLVTVSA

SEQ ID NO: 179 - protein, 122 aa, Artificial Sequence
  Synthesized sequence with two or more selenocysteine residues substituted for two or more cysteine residues
  VARIANT (1)...(122): Xaa = selenocysteine or cysteine
QVQLQQWGAGLLKPSETLSLTXAVYGGSFSGYNWHWIRQPPGKGLEWIGEITHSGSTNYNPSLKSRVTISVDTSKNQFSLKLSSVTAADTAVYYXVREIAVAGTGYYGMDVWGQGTTVTVSS

SEQ ID NO: 180 - protein, 114 aa, Artificial Sequence
  Synthesized sequence with two or more selenocysteine residues substituted for two or more cysteine residues
  VARIANT (1)...(114): Xaa = selenocysteine or cysteine
DVQLQESGPGLVKPSQSLSLTXSVTGYSITSGYYWNWIRQFPGNKLEWMGYISYDGSNNYNPSLKNRISITRDTSKNQFFLKLNSVTTEDTATYYXAILGRGYWGQGTTLTVSS

SEQ ID NO: 181 - protein, 119 aa, Artificial Sequence
  Synthesized sequence with two or more selenocysteine residues substituted for two or more cysteine residues
  VARIANT (1)...(119): Xaa = selenocysteine or cysteine
EVQLVQSGAEVKKPGASVKVSXKASGYSFTGYFMNWVRQAPGQGLEWIGRINPYTGDTFYNQKFKGRVTITVDKSTSTAYMELSSLRSEDTAVYYXGRLGSRYWYFDVWGQGTTVTVSS

SEQ ID NO: 182 - protein, 119 aa, Artificial Sequence
  Synthesized sequence with two or more selenocysteine residues substituted for two or more cysteine residues
  VARIANT (1)...(119): Xaa = selenocysteine or cysteine
QVQLVQSGAEVKKPGASVKVSXKVSGYTFTDYYMNWVRQAPGQGLEWIGDINPNNGGAIYNQKFKGRATLTVDKSTSTAYMELRSLRSDDTAVYYXTSGIITEIAEDFWGQGTLVTVSS

SEQ ID NO: 183 - protein, 120 aa, Artificial Sequence
  Synthesized sequence with two or more selenocysteine residues substituted for two or more cysteine residues
  VARIANT (1)...(120): Xaa = selenocysteine or cysteine
QVQLVQSGAEVKKPGASVKVSXKASGYIFTDYAMHWVRQAPGQGLEWMGTFIPLLDTSDYNQNFKGRVTMTTDTSTSTAYMELRSLRSDDTAVYYXARMGVTHSYVMDAWGQGTLVTVSS

SEQ ID NO: 184 - protein, 117 aa, Artificial Sequence
  Synthesized sequence with two or more selenocysteine residues substituted for two or more cysteine residues
  VARIANT (1)...(117): Xaa = selenocysteine or cysteine
DVQLQESGPGLVKPSQSLSLTXTVTAYSVTSDYAWNWIRQFPGNKLEWMGYISYSGTTRYNPSLKSRISITRDTSKNQFFLQLNSMTAEDTATYYXSRQGRGFPYWGQGTLVTVSAA

SEQ ID NO: 185 - protein, 119 aa, Artificial Sequence
  Synthesized sequence with two or more selenocysteine residues substituted for two or more cysteine residues
  VARIANT (1)...(119): Xaa = selenocysteine or cysteine
EVQLQQSGPELVKPGASVKMSXKASGYTFTSYVMHWVKQKPGQGLEWIGYIIPYNDGTKYNEKFKGKATLTSDKSSSTAYMELSSLTSEDSAVYYXARSEDYDHFDYWGQGTTVTVSSA

SEQ ID NO: 186 - protein, 120 aa, Artificial Sequence
  Synthesized sequence with two or more selenocysteine residues substituted for two or more cysteine residues
  VARIANT (1)...(120): Xaa = selenocysteine or cysteine
EVQLVESGGGLVQPGGSLRLSXAASGFTFSSYGMHWVRQAPGKGLEWVAYITTRSSTIYYADSVKGRFTISRDNAKNSLYLQMNSLRAEDTAVYYXTREPLTGYYAMDYWGQGTSVTVSS

SEQ ID NO: 187 - protein, 117 aa, Artificial Sequence
  Synthesized sequence with two or more selenocysteine residues substituted for two or more cysteine residues
  VARIANT (1)...(117): Xaa = selenocysteine or cysteine
QAQLQQSGPELVKPGALVKISXKASGYIFTNYDINWVKQRPGQGLEWIGLIYPGDGSIKYNEKFKGKATLTADKSSSTAYMQLSSQTSENSAVYFXARSGPYYFDYLGPRHHSHSSR

SEQ ID NO: 188 - protein, 118 aa, Artificial Sequence
  Synthesized sequence with two or more selenocysteine residues substituted for two or more cysteine residues
  VARIANT (1)...(118): Xaa = selenocysteine or cysteine
EVMLVESGGALVKPGGSLKLSXAASGFTFSNYAMSWVRQIPEKRLEWVATISSGGSHTYYLDSVKGRFTISRDNARDTLYLQMSSLRSEDTALYYXARLFTGYAMDYWGQGTSVTVSS

SEQ ID NO: 189 - protein, 117 aa, Artificial Sequence
  Synthesized sequence with two or more selenocysteine residues substituted for two or more cysteine residues
  VARIANT (1)...(117): Xaa = selenocysteine or cysteine
EIQLQQSGPELVKPGASVQVSXKTSGYSFTDYNVYWVRQSHGKSLEWIGYIDPYNGITIYDQNFKGKATLTVDKSSTTAFMHLNSLTSDDSAVYFXARDVTTALDFWGQGTTLTVSS

SEQ ID NO: 190 - protein, 119 aa, Artificial Sequence
  Synthesized sequence with two or more selenocysteine residues substituted for two or more cysteine residues
  VARIANT (1)...(119): Xaa = selenocysteine or cysteine
QVQLQQSGAELARPGASVKMSXKASGYTFTSYTMHWVKQRPGQGLEWIGYINPSSGYTNYNQKFKDKATLTADKSSSTAYMQLSSLTSEDSAVYYXARWRDAYYAMDYWGQGTSVTVSS

SEQ ID NO: 191 - protein, 121 aa, Artificial Sequence
  Synthesized sequence with two or more selenocysteine residues substituted for two or more cysteine residues
  VARIANT (1)...(121): Xaa = selenocysteine or cysteine
QAYLQQSGAESVRPGASVKMSXKASGYTFTSYNMHWVKQTPRQGLEWIGAIYPGNGDTSYNQKFKGKATLTVDKSSSTAYMQLSSLTSEDSAVYFXARVVYYSNSYWYFDVWGTGTTVTVS

SEQ ID NO: 192 - protein, 120 aa, Artificial Sequence
  Synthesized sequence with two or more selenocysteine residues substituted for two or more cysteine residues
  VARIANT (1)...(120): Xaa = selenocysteine or cysteine
AVTLDESGGGLQTPGGGLSLVXKASGFTFSSFDMGWVRQAPGKGLEFVAQINDAGSRTWYATAVKGRATISRDNGQTTVRLQLNNLRAEDTGTYYXTRGSGYVGAGAIDAWGHGTEVIVS

SEQ ID NO: 193 - protein, 116 aa, Artificial Sequence
  Synthesized sequence with two or more selenocysteine residues substituted for two or more cysteine residues
  VARIANT (1)...(116): Xaa = selenocysteine or cysteine
EFQQSGPELVEPGASVKISXKASGYSFTDYNMNWVKQSNGKSLEWIGVINPNYGTTSYNQKFKGKATLTVDQSSSTAYMQLNSLTSEDSAVYYXARFDGYYGYYFDYWGQGTTLTV

SEQ ID NO: 194 - protein, 124 aa, Artificial Sequence
  Synthesized sequence with two or more selenocysteine residues substituted for two or more cysteine residues
  VARIANT (1)...(124): Xaa = selenocysteine or cysteine
EVQLLESGAEVKRPGSSVRVSXQVSGYSFTAYYVSWVRQTPGHGLEWMGGINPDNGGNNYAQKFHGRVTFIADESTRTVHMELRSLRSEDTAVYFXAKSTSYDYDGYWYFDVWGQGTAVTVFSS

SEQ ID NO: 195 - protein, 116 aa, Artificial Sequence
  Synthesized sequence with two or more selenocysteine residues substituted for two or more cysteine residues
  VARIANT (1)...(116): Xaa = selenocysteine or cysteine
QVQLQESGPGLVRPSQTLSLTXTVSGFTFTYYGVHWVRQPPGRGLEWIGIIWAGGNTNYNSTLKSRATMLVDTSKNQFSLRLSSVTAADTAVYYXARDDYAAMDYWGQGSLVTVSS

SEQ ID NO: 196 - protein, 119 aa, Artificial Sequence
  Synthesized sequence with two or more selenocysteine residues substituted for two or more cysteine residues
  VARIANT (1)...(119): Xaa = selenocysteine or cysteine
QVTLKESGPGILQPSQTLSLTXSFSGFSLSTFGMGVGWIRQPSGKGLEWLAHIWWDDDKYYSPALKSRLTISKDTSKNQVFLKIANVDTADTATYYXVRIGSRSPFAYWGPGTLVTVSS

SEQ ID NO: 197 - protein, 117 aa, Artificial Sequence
  Synthesized sequence with two or more selenocysteine residues substituted for two or more cysteine residues
  VARIANT (1)...(117): Xaa = selenocysteine or cysteine
QVQLQQSGAELVKPGASVKLSXKTSGYTFSNYYMSWLKQMPGQNIEWIGNIYGGNGGTGYNQKFKGKATLTVDKSSSTAYMQLSSLTSEDSAVYFXARGDLYAMDYWGQGTTVTVSS

SEQ ID NO: 198 - protein, 122 aa, Artificial Sequence
  Synthesized sequence with two or more selenocysteine residues substituted for two or more cysteine residues
  VARIANT (1)...(122): Xaa = selenocysteine or cysteine
EVQLHQSGPELVKPGASVKISXKTSGYTFTEYTMHWVKQSHGKSLEWIGGVNPYNDNTSYIRKLQGKVTLTVDRSSSTAYMELRSLTSEDSAVYFXARYGGLRPYYFPMDFWGQGTSVTVSS

SEQ ID NO: 199 - protein, 119 aa, Artificial Sequence
  Synthesized sequence with two or more selenocysteine residues substituted for two or more cysteine residues
  VARIANT (1)...(119): Xaa = selenocysteine or cysteine
QVQLKESGPGLVAPSQSLSITXTVSGFSLTTYGVHWIRQPPGKGLEWLVVIWSDGYTTYNSALKSRLSITKDNSKSQVFLKMNSLQTDDTAMYYXARNDGDYFYSMDYWGQGTSVTVSS

SEQ ID NO: 200 - protein, 119 aa, Artificial Sequence
  Synthesized sequence with two or more selenocysteine residues substituted for two or more cysteine residues
  VARIANT (1)...(119): Xaa = selenocysteine or cysteine
EVQLQESGPGLVKPSQTLSLTXTVTGYSITSDYAWNWIRQPPGKKLEWMGYINYSGSTSYNPSLKSRVTISRDTSKNQFSLKLSSVTAADTAVYYXARWIGSSAWYFDVWGQGTLVTVS

SEQ ID NO: 201 - protein, 120 aa, Artificial Sequence
  Synthesized sequence with two or more selenocysteine residues substituted for two or more cysteine residues
  VARIANT (1)...(120): Xaa = selenocysteine or cysteine
EVQLLESGGDLVQPGGSLRLSXAASGFTFSNYAMSWVRQAPGKGLEWVSAITPSGGSTNYADSVKGRFTISRDNSQNTLYLQMNSLRVEDTAVYYXGRVPYRSTWYPLYWGQGTLVTVSS

SEQ ID NO: 202 - protein, 118 aa, Artificial Sequence
  Synthesized sequence with two or more selenocysteine residues substituted for two or more cysteine residues
  VARIANT (1)...(118): Xaa = selenocysteine or cysteine
EVQLQQSGPELVKPGASVKISXKASGYTFTGYYMHWVKQSPEKSLEWIGEINPSTGGTTYNQKFTGKATLTVDKSSSTAYMQLKSLTSDDSAVYYXASYYRYDWFAYWGQGTLVTVSA

SEQ ID NO: 203 - protein, 121 aa, Artificial Sequence
  Synthesized sequence with two or more selenocysteine residues substituted for two or more cysteine residues
  VARIANT (1)...(121): Xaa = selenocysteine or cysteine
EVQLVESGGGLVQPGRSLRLSXAASGFTFDDYAMHWVRQAPGKGLEWVSAITWNSGHIDYADSVEGRFTISRDNAKNSLYLQMNSLRAEDTAVYYXAKVSYLSTASSLDYWGQGTLVTVSS

SEQ ID NO: 204 - protein, 116 aa, Artificial Sequence
  Synthesized sequence with two or more selenocysteine residues substituted for two or more cysteine residues
  VARIANT (1)...(116): Xaa = selenocysteine or cysteine
QLQQSGTVLARPGASVKMSXKASGYSFTRYWMHWIKQRPGQGLEWIGAIYPGNSDTSYNQKFEGKAKLTAVTSASTAYMELSSLTHEDSAVYYXSRDYGYYFDFWGQGTTLTVSSA

SEQ ID NO: 205 - protein, 124 aa, Artificial Sequence
  Synthesized sequence with two or more selenocysteine residues substituted for two or more cysteine residues
  VARIANT (1)...(124): Xaa = selenocysteine or cysteine
QVQLQQSGAEVKKPGSSVRVSXKASGGTFNNNAINWVRQAPGQGLEWMGGIIPMFGTAKYSQNFQGRVAITADESTGTASMELSSLRSEDTAVYYXARSRDLLLFPHHALSPWGRGTMVTVSSG

SEQ ID NO: 206 - protein, 125 aa, Artificial Sequence
  Synthesized sequence with two or more selenocysteine residues substituted for two or more cysteine residues
  VARIANT (1)...(125): Xaa = selenocysteine or cysteine
QVQLQQSGAELVRPGSSVKISXKASGYAFSSYWMNWVKQRPGQGLEWIGQIWPGDGDTNYNGKFKGKATLTADESSSTAYMQLSSLASEDSAVYFXARRETTTVGRYYYAMDYWGQGTTVTVSSG

SEQ ID NO: 207 - protein, 118 aa, Artificial Sequence
  Synthesized sequence with two or more selenocysteine residues substituted for two or more cysteine residues
  VARIANT (1)...(118): Xaa = selenocysteine or cysteine
QVQLVESGGGVVQPGRSLRLSXAASGFTFSVYGMNWVRQAPGKGLEWVAIIWYDGDNQYYADSVKGRFTISRDNSKNTLYLQMNGLRAEDTAVYYXARDLRTGPFDYWGQGTLVTVSS

SEQ ID NO: 208 - protein, 119 aa, Artificial Sequence
  Synthesized sequence with two or more selenocysteine residues substituted for two or more cysteine residues
  VARIANT (1)...(119): Xaa = selenocysteine or cysteine
QVQLVQSGAEVKKPGETVKISXKASDYTFTYYGMNWVKQAPGQGLKWMGWIDTTTGEPTYAQKFQGRIAFSLETSASTAYLQIKSLKSEDTATYFXARRGPYNWYFDVWGQGTTVTVSS

SEQ ID NO: 209 - protein, 119 aa, Artificial Sequence
  Synthesized sequence with two or more selenocysteine residues substituted for two or more cysteine residues
  VARIANT (1)...(119): Xaa = selenocysteine or cysteine
EVQLVESGGGLVQPGGSLRLSXAASGYVFTDYGMNWVRQAPGKGLEWMGWINTYIGEPIYADSVKGRFTFSLDTSKSTAYLQMNSLRAEDTAVYYXARGYRSYAMDYWGQGTLVTVSSA

SEQ ID NO: 210 - protein, 120 aa, Artificial Sequence
  Synthesized sequence with two or more selenocysteine residues substituted for two or more cysteine residues
  VARIANT (1)...(120): Xaa = selenocysteine or cysteine
QVQLKQSGPGLVQPSQSLSITXTVSGFSLTNYGVHWVRQSPGKGLEWLGVIWSGGNTDYNTPFTSRLSINKDNSKSQVFFKMNSLQSNDTAIYYXARALTYYDYEFAYWGQGTLVTVSAA

SEQ ID NO: 211 - protein, 117 aa, Artificial Sequence
  Synthesized sequence with two or more selenocysteine residues substituted for two or more cysteine residues
  VARIANT (1)...(117): Xaa = selenocysteine or cysteine
EVQLVQSGPGLVQPGGSVRISXAASGYTFTNYGMNWVKQAPGKGLEWMGWINTYTGESTYADSFKGRFTFSLDTSASAAYLQINSLRAEDTAVYYXARFAIKGDYWGQGTLLTVSSA

SEQ ID NO: 212 - protein, 119 aa, Artificial Sequence
  Synthesized sequence with two or more selenocysteine residues substituted for two or more cysteine residues
  VARIANT (1)...(119): Xaa = selenocysteine or cysteine
EVQLVESGGGLVQPGGSLRLSXAVSGFSSTNYHVHWVRQAPGKGLEWMGVIWGDGDTSYNSVLKSRFTISRDTSKNTVYLQMNSLRAEDTAVYYXARQLTHYYVLAAWGQGTLVTVSSA

SEQ ID NO: 213 - protein, 122 aa, Artificial Sequence
  Synthesized sequence with two or more selenocysteine residues substituted for two or more cysteine residues
  VARIANT (1)...(122): Xaa = selenocysteine or cysteine
EVQLLESGGGLVQPGGSLRLSXAASGFTFSSYAMSWVRQAPGKGLEWVSGITGSGGSTYYADSVKGRFTISRDNSKNTLYLQMNSLRAEDTAVYYXAKDPGTTVIMSWFDPWGQGTLVTVSS

SEQ ID NO: 214 - protein, 122 aa, Artificial Sequence
  Synthesized sequence with two or more selenocysteine residues substituted for two or more cysteine residues
  VARIANT (1)...(122): Xaa = selenocysteine or cysteine
EVQLVESGGGLVQPGGSLRLSXAASGYSFTGHWMNWVRQAPGKGLEWVGMIHPSDSETRYNQKFKDRFTISVDKSKNTLYLQMNSLRAEDTAVYYXARGIYFYGTTYFDYWGQGTLVTVSSA

SEQ ID NO: 215 - protein, 123 aa, Artificial Sequence
  Synthesized sequence with two or more selenocysteine residues substituted for two or more cysteine residues
  VARIANT (1)...(123): Xaa = selenocysteine or cysteine
QVTLKESGPGILKPSQTLSLTXSFSGFSLSTSGMGVGWIRQPSGKGLEWLAHIWWDDDKYYNPSLKSQLTISKDTSRNQVFLKITSVDTADTATYYXARSYDDYLYYALDYWGQGTSVTVSSA

SEQ ID NO: 216 - protein, 123 aa, Artificial Sequence
  Synthesized sequence with two or more selenocysteine residues substituted for two or more cysteine residues
  VARIANT (1)...(123): Xaa = selenocysteine or cysteine
EVQLLESGGGLVQPGGSLRLSXAASGFTFSSYAMSWVRQAPGKGLEWVSAISGSGGSTYYADSVKGRFTISRDNSKNTLYLQMNSLRAEDTAVYYXAKDGSSGWYVPHWFDPWGQGTLVTVSS

SEQ ID NO: 217 - protein, 126 aa, Artificial Sequence
  Synthesized sequence with two or more selenocysteine residues substituted for two or more cysteine residues
  VARIANT (1)...(126): Xaa = selenocysteine or cysteine
QVQLVESGGGVVQPGRSLRLSXAASGFIFSSYAMHWVRQAPGNGLEWVAFMSYDGSNKKYADSVKGRFTISRDNSKNTLYLQMNSLRAEDTAVYYXARDRGIAAGGNYYYYGMDVWGQGTTVTVSS

SEQ ID NO: 218 - protein, 121 aa, Artificial Sequence
  Synthesized sequence with two or more selenocysteine residues substituted for two or more cysteine residues
  VARIANT (1)...(121): Xaa = selenocysteine or cysteine
QVQLVESGGGLVQPGRSLRLSXAASGFTFDDYAMHWVRQAPGKGLDWVSAITWNSGHIDYADSVEGRFAVSRDNAKNALYLQMNSLRPEDTAVYYXTKASYLSTSSSLDNWGQGTLVTVSS

SEQ ID NO: 219 - protein, 121 aa, Artificial Sequence
  Synthesized sequence with two or more selenocysteine residues substituted for two or more cysteine residues
  VARIANT (1)...(121): Xaa = selenocysteine or cysteine
QVQLQQPGAELVKAGASVKMSXKASGYTFTSYNMHWVKQTPGRGLEWIGAIYPGNGDTSYNQKFKGKATLTADKSSSTAYMQLSSLTSEDSAVYYXARSTYYGGDWYFNVWGAGTTVTVSA

SEQ ID NO: 220 - protein, 119 aa, Artificial Sequence
  Synthesized sequence with two or more selenocysteine residues substituted for two or more cysteine residues
  VARIANT (1)...(119): Xaa = selenocysteine or cysteine
EVKLEESGGGLVQPGGSMKLSXVASGFIFSNHWMNWVRQSPEKGLEWVAEIRSKSINSATHYAESVKGRFTISRDDSKSAVYLQMTDLRTEDTGVYYXSRNYYGSTYDYWGQGTTLTVS

SEQ ID NO: 221 - protein, 118 aa, Artificial Sequence
  Synthesized sequence with two or more selenocysteine residues substituted for two or more cysteine residues
  VARIANT (1)...(118): Xaa = selenocysteine or cysteine
QVQLVESGGGVVQPGRSLRLSXAASGFTFSSYTMHWVRQAPGKGLEWVTFISYDGNNKYYADSVKGRFTISRDNSKNTLYLQMNSLRAEDTAIYYXARTGWLGPFDYWGQGTLVTVSS

SEQ ID NO: 222 - protein, 119 aa, Artificial Sequence
  Synthesized sequence with two or more selenocysteine residues substituted for two or more cysteine residues
  VARIANT (1)...(119): Xaa = selenocysteine or cysteine
EVQLVESGGGVVQPGRSLRLSXSASGFDFTTYWMSWVRQAPGKGLEWIGEIHPDSSTINYAPSLKDRFTISRDNAKNTLFLQMDSLRPEDTGVYFXASLYFGFPWFAYWGQGTPVTVSS

SEQ ID NO: 223 - protein, 118 aa, Artificial Sequence
  Synthesized sequence with two or more selenocysteine residues substituted for two or more cysteine residues
  VARIANT (1)...(118): Xaa = selenocysteine or cysteine
EVQLVESGGGLAKPGGSLRLSXAASGFRFTFNNYYMDWVRQAPGQGLEWVSRISSSGDPTWYADSVKGRFTISRENANNTLFLQMNSLRAEDTAVYYXASLTTGSDSWGQGVLVTVSS

SEQ ID NO: 224 - protein, 122 aa, Artificial Sequence
  Synthesized sequence with two or more selenocysteine residues substituted for two or more cysteine residues
  VARIANT (1)...(122): Xaa = selenocysteine or cysteine
QVQLVQSGAEVKKPGASVKVSXKASGYTFTSHWMHWVRQAPGQGLEWIGEFNPSNGRTNYNEKFKSKATMTVDTSTNTAYMELSSLRSEDTAVYYXASRDYDYAGRYFDYWGQGTLVTVSSA

SEQ ID NO: 225 - protein, 119 aa, Artificial Sequence
  Synthesized sequence with two or more selenocysteine residues substituted for two or more cysteine residues
  VARIANT (1)...(119): Xaa = selenocysteine or cysteine
QVTLRESGPALVKPTQTLTLTXTVSGFSLTSYSVHWVRQPPGKGLEWLGVIWASGGTDYNSALMSRLSISKDTSRNQVVLTMTNMDPVDTATYYXARDPPSSLLRLDYWGRGTPVTVSS

SEQ ID NO: 226 - protein, 125 aa, Artificial Sequence
  Synthesized sequence with two or more selenocysteine residues substituted for two or more cysteine residues
  VARIANT (1)...(125): Xaa = selenocysteine or cysteine
EVQLVESGGGLVKPGGSLKLSXAASGFAFSIYDMSWVRQTPEKXLEWVAYISSGGGTTYYPDTVKGRFTISRDNAKNTLYLQMSSLKSEDTAMYYXARHSGYGTHWGVLFAYWGQGTLVTVSAKA

SEQ ID NO: 227 - protein, 120 aa, Artificial Sequence
  Synthesized sequence with two or more selenocysteine residues substituted for two or more cysteine residues
  VARIANT (1)...(120): Xaa = selenocysteine or cysteine
VKLQQSGAELVKPGASVKLFXTASGFNIKDTYMHWVKQRPQQGLEWIGRIDPASGDTKYDPKFQVKATITADTSSNTAWLQLSSLTSEDTAVYYXADGMWVSTGYALDFWGQGTTVTVSS

SEQ ID NO: 228 - protein, 124 aa, Artificial Sequence
  Synthesized sequence with two or more selenocysteine residues substituted for two or more cysteine residues
  VARIANT (1)...(124): Xaa = selenocysteine or cysteine
QVQLQQSGAEVKKPGSSVKVSXKASGYTFTNYYIYWVRQAPGQGLEWIGGINPTSGGSNFNEKFKTRVTITADESSTTAYMELSSLRSEDTAFYFXTRQGLWFDSDGRGFDFWGQGTTVTVSSA

SEQ ID NO: 229 - protein, 123 aa, Artificial Sequence
  Synthesized sequence with two or more selenocysteine residues substituted for two or more cysteine residues
  VARIANT (1)...(123): Xaa = selenocysteine or cysteine
EVQLVESGGGLVQPGRSLRLSXAASGFTFNDYAMHWVRQAPGKGLEWVSTISWNSGSIGYADSVKGRFTISRDNAKKSLYLQMNSLRAEDTALYYXAKDIQYGNYYYGMDVWGQGTTVTVSSA

SEQ ID NO: 230 - protein, 117 aa, Artificial Sequence
  Synthesized sequence with two or more selenocysteine residues substituted for two or more cysteine residues
  VARIANT (1)...(117): Xaa = selenocysteine or cysteine
EVQLVQSGPGLVQPGGSVRISXAASGYTFTNYGMNWVKQAPGKGLEWMGWINTYTGESTYADSFKGRFTFSLDTSASAAYLQINSLRAEDTAVYYXARFAIKGDYWGQGTLLTVSSE

SEQ ID NO: 231 - protein, 117 aa, Artificial Sequence
  Synthesized sequence with two or more selenocysteine residues substituted for two or more cysteine residues
  VARIANT (1)...(117): Xaa = selenocysteine or cysteine
EVQLVQSGAEVKKPGESLKISXKGSGYSFTGYNMNWVRQMPGKGLEWMGNIDPYYGGTTYNRKFKGQVTISADKSISTAYLQWSSLKASDTAMYYXARSVGPFDSWGQGTLVTVSSG

SEQ ID NO: 232 - protein, 120 aa, Artificial Sequence
  Synthesized sequence with two or more selenocysteine residues substituted for two or more cysteine residues
  VARIANT (1)...(120): Xaa = selenocysteine or cysteine
EVQLVESGGGLVQPGGSLRLSXAASGFTFTDYTMDWVRQAPGKGLEWVADVNPNSGGSIYNQRFKGRFTLSVDRSKNTLYLQMNSLRAEDTAVYYXARNLGPSFYFDYWGQGTLVTVSSA

SEQ ID NO: 233 - protein, 117 aa, Artificial Sequence
  Synthesized sequence with two or more selenocysteine residues substituted for two or more cysteine residues
  VARIANT (1)...(117): Xaa = selenocysteine or cysteine
EVQLLESGGGLVQPGGSLRLSXAASGFTFSSFSMSWVRQAPGKGLEWVSSISGSSGTTYYADSVKGRFTISRDNSKNTLYLQMNSLRAEDTAVYYXAKPFPYFDYWGQGTLVTVSSG

SEQ ID NO: 234 - protein, 124 aa, Artificial Sequence
  Synthesized sequence with two or more selenocysteine residues substituted for two or more cysteine residues
  VARIANT (1)...(124): Xaa = selenocysteine or cysteine
EVQLVESGGGLVQPGGSLRLSXAASGYDFTHYGMNWVRQAPGKGLEWVGWINTYTGEPTYAADFKRRFTFSLDTSKSTAYLQMNSLRAEDTAVYYXAKYPYYYGTSHWYFDVWGQGTLVTVSSA

SEQ ID NO: 235 - protein, 119 aa, Artificial Sequence
  Synthesized sequence with two or more selenocysteine residues substituted for two or more cysteine residues
  VARIANT (1)...(119): Xaa = selenocysteine or cysteine
QVQLVQSGAEVVKPGASVKLSXKASGYIFTSYYMYWVKQAPGQGLEWIGEINPSNGDTNFNEKFKSKATLTVDKSASTAYMELSSLRSEDTAVYYXTRSDGRNDMDSWGQGTLVTVSSA

SEQ ID NO: 236 - protein, 123 aa, Artificial Sequence
  Synthesized sequence with two or more selenocysteine residues substituted for two or more cysteine residues
  VARIANT (1)...(123): Xaa = selenocysteine or cysteine
EEQVLESGGGLVKPGGSLRLSXAASGFTFSPYSVFWVRQAPGKGLEWVSSINSDSTYKYYADSVKGRFTISRDNAENSIFLQMNSLRAEDTAVYYXARDRSYYAFSSGSLSDYYYGLDVWGQG

SEQ ID NO: 237 - protein, 124 aa, Artificial Sequence
  Synthesized sequence with two or more selenocysteine residues substituted for two or more cysteine residues
  VARIANT (1)...(124): Xaa = selenocysteine or cysteine
QVQLVQSGAEVKKPGASVKVSXKTSRYTFTEYTIHWVRQAPGQRLEWIGGINPNNGIPNYNQKFKGRVTITVDTSASTAYMELSSLRSEDTAVYYXARRRIAYGYDEGHAMDYWGQGTLVTVSS

SEQ ID NO: 238 - protein, 123 aa, Artificial Sequence
  Synthesized sequence with two or more selenocysteine residues substituted for two or more cysteine residues
  VARIANT (1)...(123): Xaa = selenocysteine or cysteine
QVQLVQSGAEVKKPGASVKVSXKASGYTFTGYYMHWVRQAPGQGLEWMGRINPNSGGTNYAQKFQGRVTMTRDTSISTAYMELSRLRSDDTAVYYXARGRTEYIVVAEGFDYWGQGTLVTVSS

SEQ ID NO: 239 - protein, 121 aa, Artificial Sequence
  Synthesized sequence with two or more selenocysteine residues substituted for two or more cysteine residues
  VARIANT (1)...(121): Xaa = selenocysteine or cysteine
EVQLLEQSGAELVRPGTSVKISXKASGYAFTNYWLGWVKQRPGHGLEWIGDIFPGSGNIHYNEKFKGKATLTADKSSSTAYMQLSSLTFEDSAVYFXARLRNWDEPMDYWGQGTTVTVSSG

SEQ ID NO: 240 - protein, 122 aa, Artificial Sequence
  Synthesized sequence with two or more selenocysteine residues substituted for two or more cysteine residues
  VARIANT (1)...(122): Xaa = selenocysteine or cysteine
EVQLVQSGAEVKKPGESLKISXQSFGYIFIDHTIHWMRQMPGQGLEWMGAISPRHDITKYNEMFRGQVTISADKSSSTAYLQWSSLKASDTAMYFXARGGFYGSTIWFDFWGQGTMVTVSSA

SEQ ID NO: 241 - protein, 123 aa, Artificial Sequence
  Synthesized sequence with two or more selenocysteine residues substituted for two or more cysteine residues
  VARIANT (1)...(123): Xaa = selenocysteine or cysteine
QVQLVQSGAEVMKPGSSVKVSXKASGYTFSMYWLEWVRQAPGHGLEWMGEIDPGTFETNYNEKFKARVTFTADTSTSTAYMELSSLRSEDTAVYYXARFSHFSGSNYDYFDYWGQGTLVTVSS

SEQ ID NO: 242 - protein, 125 aa, Artificial Sequence
  Synthesized sequence with two or more selenocysteine residues substituted for two or more cysteine residues
  VARIANT (1)...(125): Xaa = selenocysteine or cysteine
QVQLVESGGGVVQPGRSLRLSXAASGFTFSTYGMHWVRQAPGKGLEWVAVIWDDGSYKYYGDSVKGRFTISRDNSKNTLYLQMNSLRAEDTAVYYXARDGITMVRGVMKDYFDYWGQGTLVTVSS

SEQ ID NO: 243 - protein, 112 aa, Artificial Sequence
  Synthesized sequence with two or more selenocysteine residues substituted for two or more cysteine residues
  VARIANT (1)...(112): Xaa = selenocysteine or cysteine
QVQLQQWGAGLLKPSETLSLTXAVYGGSFSGYYWSWIRQPPGKGLEWIGEINHSGSTNYNPSLKSRVTISVDTSKNQFSLKLSSVTAADTAVYYXARVINWFDPWGQGTLVT

SEQ ID NO: 244 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQTTSSLSASLGDRVTISXRASQDISNYLNWYQQKPDGTVKLLIYYTSRLHSGVTSRFSGSGSGTDYSLTISNLEQEDIATYFXQQGNTLPWTFGGGTKVEIKR

SEQ ID NO: 245 - protein, 112 aa, Artificial Sequence
  Synthesized sequence with two or more selenocysteine residues substituted for two or more cysteine residues
  VARIANT (1)...(112): Xaa = selenocysteine or cysteine
DIVMTQAAPSVPVTPGESVSISXRSTKSLLHSNGNTYLYWFLQRPGQSPQLLIYRMSNLASGVPDRFSGSGSGTAFTLRISRVEAEDVGVYYXMQHLEYPFTFGGGTKLEIK

SEQ ID NO: 246 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTISXRASQDIRNYLNWYQQKPGKAPKLLIFYTSKLHSGVPSRFSGSGSGTDYTLTISSLQPEDIATYYXQQGNTLPLTFGGGTKVEIK

SEQ ID NO: 247 - protein, 109 aa, Artificial Sequence
  Synthesized sequence with two or more selenocysteine residues substituted for two or more cysteine residues
  VARIANT (1)...(109): Xaa = selenocysteine or cysteine
EIVMTQSPATLSVSPGERATLSXRASESISSNLAWYQQKPGQAPRLFIYTASTRATDIPARFSGSGSGTEFTLTISSLQSEDFAVYYXQQYNNWPSITFGQGTRLEIKR

SEQ ID NO: 248 - protein, 107 aa, Artificial Sequence
  Synthesized sequence with two or more selenocysteine residues substituted for two or more cysteine residues
  VARIANT (1)...(107): Xaa = selenocysteine or cysteine
EIVLTQSPGTLSLSPGERATLSXRASQSVSSSFLAWYQQKPGQAPRLLIYGASSRATGIPDRFSGSGSGTDFILTISRLEPEDFAVYYXQQYDSSFTFGPGTKVDIK

SEQ ID NO: 249 - protein, 109 aa, Artificial Sequence
  Synthesized sequence with two or more selenocysteine residues substituted for two or more cysteine residues
  VARIANT (1)...(109): Xaa = selenocysteine or cysteine
EIVLTQSPATLSLSPGERATLSXSAGSSVDSSYLYWYQQKPGQAPRLLIYSTSNLASGIPARFSGSGSGTDFTLTISSLEPEDFAVYYXHQWSSYPFTFGQGTKLEIKR

SEQ ID NO: 250 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPGTLSLSPGERATLSXRASQSVSSSYLAWYQQKPGQAPRLLIYGASRRATGIPDRFSGSGSGTDFTLTISRLEPEDFAVYYXQRYGSSHTFGQGTKLEISR

SEQ ID NO: 251 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPGTLSLSPGERATLSXRASQSVSSSYLAWYQQKPGQAPRLLIYGASSRATGIPDRFSGSGSGTDFTLTISRLEPEDFAVYYXQRSGGSSFTFGPGTKVDIK

SEQ ID NO: 252 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTIKXQASQSISSRLAWYQQKPGKPPKLLIYRASTLASGVPSRFSGSGSGTDFTLTISSLQPEDVATYYXQXTGYGISWPIGGGTKVEIK

SEQ ID NO: 253 - protein, 110 aa, Artificial Sequence
  Synthesized sequence with two or more selenocysteine residues substituted for two or more cysteine residues
  VARIANT (1)...(110): Xaa = selenocysteine or cysteine
DIQMTQSPSSLSASVGDRVTISXQSSQSVYNNNYLAWFQQKPGKPPKLLIYGASNLASGVPSRFSGSGSGTQFTLTISSLQPEDVATYYXQGYYNGVIFVFGGGTKVEIK

SEQ ID NO: 254 - protein, 113 aa, Artificial Sequence
  Synthesized sequence with two or more selenocysteine residues substituted for two or more cysteine residues
  VARIANT (1)...(113): Xaa = selenocysteine or cysteine
DIVMTQSPLSLPVTPGEPASISXRSSQSLLHSNGFNYLGWYLQKPGQSPQLLIYLGSNRASGVPDRFSGSGSGTDFTLKISRVEAEDVGVYYXMQALQTPYTFGQGTKLEIKR

SEQ ID NO: 255 - protein, 107 aa, Artificial Sequence
  Synthesized sequence with two or more selenocysteine residues substituted for two or more cysteine residues
  VARIANT (1)...(107): Xaa = selenocysteine or cysteine
DIRMTQSPSSLSASVGDRVTITXRASQSISSYLNWYQQKPGKAPKLLIYAASSLQSGVPSRFSGSGSGTDFTLTISSLQPEDFATYYXQQSYSTPLTFGGGTKVEIK

SEQ ID NO: 256 - protein, 108 aa, Artificial Sequence
  Synthesized sequence with two or more selenocysteine residues substituted for two or more cysteine residues
  VARIANT (1)...(108): Xaa = selenocysteine or cysteine
DIVMTQSQKFMSTTVGDRVSLTXKASQSVGTAVAWYQEKTGQSPKLLIYSASNRYTGVPDRFTGSGSGTDFILTIRNMQSVDLADYFXQQYFTYPYTFGGGTKLEIQR

SEQ ID NO: 257 - protein, 108 aa, Artificial Sequence
  Synthesized sequence with two or more selenocysteine residues substituted for two or more cysteine residues
  VARIANT (1)...(108): Xaa = selenocysteine or cysteine
DIVLTQSPATLSVTPGDSVSLSXRASQSIRSNLHWYQQKSHESPRLLIKYASQSISGIPSRFSGSGSGTDFILSINSVATEDFGVYFXQQSNSWPLTFGAGTKLELKR

SEQ ID NO: 258 - protein, 108 aa, Artificial Sequence
  Synthesized sequence with two or more selenocysteine residues substituted for two or more cysteine residues
  VARIANT (1)...(108): Xaa = selenocysteine or cysteine
QDIQMTQSPSSLSASVGDRVTITXRASQGVNNFLAWYQQKPGKAPRLLIYAASTLQSGVPSRFSGSGSGTDFTLSISNLQPEDFATYYXQQSYSTPRGFGQGTKVEIK

SEQ ID NO: 259 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTITXRASENIYNNLAWYQQKPGKAPKLLVYAATNLADGVPSRFSGSGSGTQYTLTISSLQPEDFATYYXDHLWTSPYTFGGGTKVEIK

SEQ ID NO: 260 - protein, 105 aa, Artificial Sequence
  Synthesized sequence with two or more selenocysteine residues substituted for two or more cysteine residues
  VARIANT (1)...(105): Xaa = selenocysteine or cysteine
ILMTQSPAIMSASPGEKVTMTXSASSSVSYMHWYQQKSGTSPKRWIYDTSKLASGVPARFSGSGSGTSYSLTISSMEAEDAATYYXQQWSSNPLTFGAGTKLEIK

SEQ ID NO: 261 - protein, 107 aa, Artificial Sequence
  Synthesized sequence with two or more selenocysteine residues substituted for two or more cysteine residues
  VARIANT (1)...(107): Xaa = selenocysteine or cysteine
SYELTQPPSVSVSPGQTARITXSGDALPKQYASWYQQKPGQAPLLVIYRDSERPSGLPERFSGSSSGTTVTLTISGVQAEDEADYYXQSADSGGSYVFGTGTKVTVL

SEQ ID NO: 262 - protein, 107 aa, Artificial Sequence
  Synthesized sequence with two or more selenocysteine residues substituted for two or more cysteine residues
  VARIANT (1)...(107): Xaa = selenocysteine or cysteine
EIVLTQSPATLSLSPGERATLSXSASSSISYMHWFQQRPGQSPRRWIYDTSKLASGVPARFSGSGSGTDYTLTISSLEPEDFATYYXHQRTSYPLTFGQGTKLEIKR

SEQ ID NO: 263 - protein, 112 aa, Artificial Sequence
  Synthesized sequence with two or more selenocysteine residues substituted for two or more cysteine residues
  VARIANT (1)...(112): Xaa = selenocysteine or cysteine
QSVLTQAPSVSGAPGQRVTISXTGRSSNIGAGYDVHWYQQFPGTAPKLLIYGNSNRPSGVPDRFSGSKSGTSASLAITGLQAEDEADYYXQSYDSSLSGSVFGGGTKLTVLG

SEQ ID NO: 264 - protein, 113 aa, Artificial Sequence
  Synthesized sequence with two or more selenocysteine residues substituted for two or more cysteine residues
  VARIANT (1)...(113): Xaa = selenocysteine or cysteine
DIALTQPASVSGSPGQSITISXTGTSSDVGGFNYVSWYQQHPGKAPKLMIHDGSNRPSGVSNRFSGSKSGNTASLTISGLQAEDEADYYXQSWDVSPITAVFGGGTKLTVLGQ

SEQ ID NO: 265 - protein, 112 aa, Artificial Sequence
  Synthesized sequence with two or more selenocysteine residues substituted for two or more cysteine residues
  VARIANT (1)...(112): Xaa = selenocysteine or cysteine
QSVLTQPPSASGTPGQRVTISXTGSSSNIGAGYDVHWYQQLPGTAPKLLIYDNNNRPSGVPDRFSGSKSGTSASLAISGLRSEDEADYYXQSYDSSLSAWLFGGGTKLTVLG

SEQ ID NO: 266 - protein, 107 aa, Artificial Sequence
  Synthesized sequence with two or more selenocysteine residues substituted for two or more cysteine residues
  VARIANT (1)...(107): Xaa = selenocysteine or cysteine
EIVLTQSPATLSLSPGERATLSXRASQSISSYLAWYQQKPGQAPRLLIYDASNRATGIPARFSGSGSGTDFTLTISSLEPEDFAVYYXQQRSNWPLTFGQGTNLEIK

SEQ ID NO: 267 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPGTLSLSPGERATLSXRASQSVSSSYLAWYQQKPGQAPRLLIYGASSRATGIPDRFSGSGSGTDFTLTISRLEPEDFAVYYXQQYGSSQYTFGQGTKLEIK

SEQ ID NO: 268 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTITXRASQGISSWLAWYQQKPEKAPKSLIYAASSLQSGVPSRFSGSGSGTDFTLTISSLQPEDFATYYXQQYNSYPPTFGGGTKVEIK

SEQ ID NO: 269 - protein, 112 aa, Artificial Sequence
  Synthesized sequence with two or more selenocysteine residues substituted for two or more cysteine residues
  VARIANT (1)...(112): Xaa = selenocysteine or cysteine
DVVMTQSPLSLPVTLGQPASISXRSSQNIVHSNGNTYLEWYLQRPGQSPRLLIYKVSNRFSGVPDRFSGSGSGTDFTLKISRVEAEDVGVYYXFQGSHVPWTFGQGTKVEIK

SEQ ID NO: 270 - protein, 112 aa, Artificial Sequence
  Synthesized sequence with two or more selenocysteine residues substituted for two or more cysteine residues
  VARIANT (1)...(112): Xaa = selenocysteine or cysteine
QSVLTQPPSASGTPGQRVTISXSGSSSNIGSNDVYWYQQLPGTAPKLLIYDNNKRPSGVPDRFSGSKSGTSASLAISGLRSEDEADYYXQSYDSSLSGSWVFGGGTKLTVLG

SEQ ID NO: 271 - protein, 109 aa, Artificial Sequence
  Synthesized sequence with two or more selenocysteine residues substituted for two or more cysteine residues
  VARIANT (1)...(109): Xaa = selenocysteine or cysteine
QIVLTQSPAIMSASPGEKVTLTXSAGSSVDSSYLYWYQQKPGSSPKLWIYSTSNLASGVPARFSGSGSGTSYSLTISSMEAEDAASYFXHQWSSYPFTFGSGTKLEIKR

SEQ ID NO: 272 - protein, 110 aa, Artificial Sequence
  Synthesized sequence with two or more selenocysteine residues substituted for two or more cysteine residues
  VARIANT (1)...(110): Xaa = selenocysteine or cysteine
DIQMTQSPSSLSASVGDRVTITXQASQDISNYLNWYQQKPGKAPKLLIYDASNLETGVPSRFSGSGSGTDFTFTISSLQPEDIATYYXQQYDNLPPELTFGGGTKVEIKR

SEQ ID NO: 273 - protein, 108 aa, Artificial Sequence
  Synthesized sequence with two or more selenocysteine residues substituted for two or more cysteine residues
  VARIANT (1)...(108): Xaa = selenocysteine or cysteine
AIQLTQSPSSLSASVGDRVTITXRASQGISSALAWYQQKPGKAPKLLIYDASSLESGVPSRFSGSGSGTDFTLTISSLQPEDFATYYXQQFNSYLITFGQGTRLEIKR

SEQ ID NO: 274 - protein, 111 aa, Artificial Sequence
  Synthesized sequence with two or more selenocysteine residues substituted for two or more cysteine residues
  VARIANT (1)...(111): Xaa = selenocysteine or cysteine
DIVLTQSPASLAVSLGQRATISYRASKSVSTSGYSYMHWNQQKPGQPPRLLIYLVSNLESEVPARFSGSGSGDTFTLNIHPVEEEDAATYYXQHIRELTRSEGGTKLEIKR

SEQ ID NO: 275 - protein, 113 aa, Artificial Sequence
  Synthesized sequence with two or more selenocysteine residues substituted for two or more cysteine residues
  VARIANT (1)...(113): Xaa = selenocysteine or cysteine
DVMMTQTPLSLPVSLGDQASISXRSSQSLVHSNGNTYLEWYMQKPGQSPMLLIYKVSNRFSGVPDRFSGSGSGTDFTLKISSVEAEDLGVFYXFQGSRVPLTFGAGTKLELKR

SEQ ID NO: 276 - protein, 111 aa, Artificial Sequence
  Synthesized sequence with two or more selenocysteine residues substituted for two or more cysteine residues
  VARIANT (1)...(111): Xaa = selenocysteine or cysteine
NFMLTQPHSVSESPGKTVTISXTRSSGSLANYYVQWYQQRPGSSPTIVIFANNQRPSGVPDRFSGSIDSSSNSASLTISGLKTEDEADYYXQTYDPYSVVFGGGTKLTVLG

SEQ ID NO: 277 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPASLSASVGETVTITXRTSGNIHNYLTWYQQNLGKSPQLLVYNAKTLADGVPSRFSGSGSGTQFSLTINSLQPEDFGNYYXQHFWSLPFTFGSGTKLEIKR

SEQ ID NO: 278 - protein, 114 aa, Artificial Sequence
  Synthesized sequence with two or more selenocysteine residues substituted for two or more cysteine residues
  VARIANT (1)...(114): Xaa = selenocysteine or cysteine
DIMMTQSPSTLSASVGDRVTITXKSSQSLLYSNNQKNYLAWYQQKPGQAPKLLISWASTRESGVPSRFIGSGSGTEFTLTISSLQPDDVATYYXQQYYDYPWTFGQGTKVEIKR

SEQ ID NO: 279 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTITXLASEDISNYLAWYQQKPGKAPKLLIYHTSRLQDGVPSRFSGSGSGTDFTLTISSLQPEDFATYYXQQGYRFPLTFGGGTKVEIK

SEQ ID NO: 280 - protein, 112 aa, Artificial Sequence
  Synthesized sequence with two or more selenocysteine residues substituted for two or more cysteine residues
  VARIANT (1)...(112): Xaa = selenocysteine or cysteine
DIVLTQSPASLAVSLGQRATISXRASKSVSSSAYSFFHWYQQKPGQPPKLLIYLASNLQSGVPARFSGSGSGTDFTLNIHPVEAEDAATYYXQHSGELPFTFGSGTKLEIKR

SEQ ID NO: 281 - protein, 110 aa, Artificial Sequence
  Synthesized sequence with two or more selenocysteine residues substituted for two or more cysteine residues
  VARIANT (1)...(110): Xaa = selenocysteine or cysteine
QSELTQPPSASGTPGQRVTISXSGSSSNIGRNYVYWYQQVPGTAPKLLIYSNNQRPSGVPDRFSGSKSGTSASLVISGLRSEDEADYYXAAWDASLRGVFGGGTKLTVLG

SEQ ID NO: 282 - protein, 108 aa, Artificial Sequence
  Synthesized sequence with two or more selenocysteine residues substituted for two or more cysteine residues
  VARIANT (1)...(108): Xaa = selenocysteine or cysteine
DIVMTQSPSSVSASVGDRVTIFXRASQDIRNWVAWYQQKPGEAPKLLIYDGSSLQSGVPSRFSGSGSGTEFTLTISSLQPEDFATYYXQQSDSTPITFGQGTRLEIKR

SEQ ID NO: 283 - protein, 107 aa, Artificial Sequence
  Synthesized sequence with two or more selenocysteine residues substituted for two or more cysteine residues
  VARIANT (1)...(107): Xaa = selenocysteine or cysteine
EIVMTQSPATLSVSPGERATFSXRASQNISTTLAWYQQKPGQAPRLLIYDTSTRATGIPARFSGSGSGTEFTLTISSLQSEDLAVYYXQQSNSWPLTFGGGTKVEIK

SEQ ID NO: 284 - protein, 108 aa, Artificial Sequence
  Synthesized sequence with two or more selenocysteine residues substituted for two or more cysteine residues
  VARIANT (1)...(108): Xaa = selenocysteine or cysteine
SIVMTQTPKFLLVSAGDRVTITXKASQSVSNDVAWYQQKPGQSPKLLIYYASNRYTGVPDRFTGSGYGTDFTFTISTVQAEDLAVYFXQQDYSSPYTFGGGTKLEIKR

SEQ ID NO: 285 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQTTSSLSASLGDRVTISXRTSQDIGNYLNWYQQKPDGTVKLLIYYTSRLHSGVPSRFSGSGSGTDYSLTISNLEQEDIATYFXQQGKSLPRTFGGGTKLEIK

SEQ ID NO: 286 - protein, 100 aa, Artificial Sequence
  Synthesized sequence with two or more selenocysteine residues substituted for two or more cysteine residues
  VARIANT (1)...(100): Xaa = selenocysteine or cysteine
DIVMTQTPLSLPVSLGDQASISXRSSQSLVHSNGKTYLHWYLQKPGQSPKLLIYKVSNRFSGVPDRFSGSGSGTDFTLKISRVEAEDLGVYFXSQSTHVP

SEQ ID NO: 287 - protein, 112 aa, Artificial Sequence
  Synthesized sequence with two or more selenocysteine residues substituted for two or more cysteine residues
  VARIANT (1)...(112): Xaa = selenocysteine or cysteine
DFVMTQTPLTLSVTIGQPASISXKSSQSLLDSDGKTYLNWLLQRPGQSPKHLIYLVSKLDSGVPDRFTGSGSGTDFTLRISRVEAEDLGVYYXWQSTHFPWTFGGGTKLEIK

SEQ ID NO: 288 - protein, 111 aa, Artificial Sequence
  Synthesized sequence with two or more selenocysteine residues substituted for two or more cysteine residues
  VARIANT (1)...(111): Xaa = selenocysteine or cysteine
DIVLTQPPSVSGAPGQRVTISXSGSSSNIGSNYVSWYQQLPGTAPKLLIYDNNQRPSGVPDRFSGSKSGTSASLAITGLQSEDEADYYXQVRDNNENEWVFGGGTKLTVLG

SEQ ID NO: 289 - protein, 108 aa, Artificial Sequence
  Synthesized sequence with two or more selenocysteine residues substituted for two or more cysteine residues
  VARIANT (1)...(108): Xaa = selenocysteine or cysteine
ELVMTQSPSSLSASVGDRVNIAXRASQGISSNLHWYQQKPGKAPRLLIKYTSRLHSGVPSRFSGSGSGTDFTLTISSLQPEDFAIYYXQQNNNWPTTFGGGTKVEIKR

SEQ ID NO: 290 - protein, 106 aa, Artificial Sequence
  Synthesized sequence with two or more selenocysteine residues substituted for two or more cysteine residues
  VARIANT (1)...(106): Xaa = selenocysteine or cysteine
DIQMTQSPSSLSASVGDRVTITXRASENIYSNLAWYQQKPGKAPKLLIYAATYLADGVPSRFSGSGSGTDYTFTISSLQPEDIATYYXQHFWGTPPFGQGTKVEIK

SEQ ID NO: 291 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXKASQDVSTAVAWYQQKPGKAPKLLIYSASYRYTGVPSRFSGSGSGTDFTLTISSLQPEDFATYYXQQHFSSPRTFGQGTKVEIKR

SEQ ID NO: 292 - protein, 109 aa, Artificial Sequence
  Synthesized sequence with two or more selenocysteine residues substituted for two or more cysteine residues
  VARIANT (1)...(109): Xaa = selenocysteine or cysteine
TQPPSASGTPGQRVTISXSGSTSNLKRNYVYWYQQLPGTAPKLLIYRDRRRPSGVPDRFSGSKSGTSASLAISGLRSEDEADYYXAWYDRELSEWVFGGGTKLTVLQPK

SEQ ID NO: 293 - protein, 107 aa, Artificial Sequence
  Synthesized sequence with two or more selenocysteine residues substituted for two or more cysteine residues
  VARIANT (1)...(107): Xaa = selenocysteine or cysteine
DIVLTQSPSSLSASVGDRVTLTXRASSSVNYMHWYQQRPGKPPKALIYATSNLASGVPSRFSGSGSGTEFTLTISSLQPEDVAVYYXQQWRTNPPTFGQGTKLEVKR

SEQ ID NO: 294 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXRASQSISNYLNWYQQKPGKAPKLLIYTASTLQSGVPSRFSGSASGTDFTLTINSLQPEDFATYSXQQSYNSPWTFGQGTKVEIKR

SEQ ID NO: 295 - protein, 109 aa, Artificial Sequence
  Synthesized sequence with two or more selenocysteine residues substituted for two or more cysteine residues
  VARIANT (1)...(109): Xaa = selenocysteine or cysteine
SSELTQDPAVSVALGQTVRITXQGDSLRKFFASWYQQKPGQAPVLVIYGKNSRPSGIPDRFSGSNSRNTASLTITGAQAEDEGDYYXNSRDSRDNHQVFGAGTKVTVLS

SEQ ID NO: 296 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXRASQWIGPELKWYQQKPGKAPKLLIYHGSILQSGVPSRFSGSGSGTDFTLTISSLQPEDFATYYXQQYMYYPHTFGQGTKVEIKR

SEQ ID NO: 297 - protein, 113 aa, Artificial Sequence
  Synthesized sequence with two or more selenocysteine residues substituted for two or more cysteine residues
  VARIANT (1)...(113): Xaa = selenocysteine or cysteine
EIVLTQSPASLAVSPGQRATITXRASESVSFLGINLIHWYQQKPGQPPKLLIYQASNKDTGVPARFSGSGSGTDFTLTINPVEANDTANYYXLQSKNFPPYTFGQGTKLEIKR

SEQ ID NO: 298 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPASLSASVGETVTITXRTSENIYIYLAWYQQKQGKSPQLLVYNAKTLAEGVPSRFSGSGSGTQFSLKINGLQPEDFGGYYXQQHYGTPYTFGGGTKLEKK

SEQ ID NO: 299 - protein, 113 aa, Artificial Sequence
  Synthesized sequence with two or more selenocysteine residues substituted for two or more cysteine residues
  VARIANT (1)...(113): Xaa = selenocysteine or cysteine
DVGMTQTPLTLSVTIGQPASFSXKSSQSLLYSNGKTYLNWLLQRPGQSPKRLIHLVSKLDSGVPDRFTGSGSGTDFTLKIGRVEAEDLGVYYXVQGTHFPYTFGGGTKLEIKR

SEQ ID NO: 300 - protein, 108 aa, Artificial Sequence
  Synthesized sequence with two or more selenocysteine residues substituted for two or more cysteine residues
  VARIANT (1)...(108): Xaa = selenocysteine or cysteine
DIVMTQSPSSLSASVGDRVTLTXTASQSVSNDVVWYQQRPGKAPKLLIYSAFNRYTGVPSRFSGRGYGTDFTLTISSLQPEDVAVYYXQQDYNSPRTFGQGTKLEVKR

SEQ ID NO: 301 - protein, 106 aa, Artificial Sequence
  Synthesized sequence with two or more selenocysteine residues substituted for two or more cysteine residues
  VARIANT (1)...(106): Xaa = selenocysteine or cysteine
QIVLTQSPAIMSASPGEKVTMTXSASSSVSYMHWYHQRSGTSPKRWIYDTSKLASGVPARFSGSGSGTSYSLTISSMEAEDAATYYXHQLSSDPFTFGSGTKLEIK

SEQ ID NO: 302 - protein, 109 aa, Artificial Sequence
  Synthesized sequence with two or more selenocysteine residues substituted for two or more cysteine residues
  VARIANT (1)...(109): Xaa = selenocysteine or cysteine
YDMTQTPASVSEPVGGTVTIKXQASENIYSSLAWYQQKPGQPPKLLIYSASTLASGVSSRFKGSGSGTEFTLTISDLEXADAATYYXQQGFGTSNVENPFGGGTEVVVK

SEQ ID NO: 303 - protein, 107 aa, Artificial Sequence
  Synthesized sequence with two or more selenocysteine residues substituted for two or more cysteine residues
  VARIANT (1)...(107): Xaa = selenocysteine or cysteine
DIVMTQSHKFMSTSVGDRVSITXKASQDVSTGVVWYQQKEGQSPKLLIYSASYRYTGVPNRFTGSGSGTDFTFTISGVQAEDLAVYYXQQHYSSPTFGGGTKLEIKR

SEQ ID NO: 304 - protein, 120 aa, Artificial Sequence
  Synthesized sequence with two or more selenocysteine residues substituted for two or more cysteine residues
  VARIANT (1)...(120): Xaa = selenocysteine or cysteine
WNDVLXSLVDLXRAXSSQASVSTQTDYLTTSPGGTVILTXRXATGAVTTSNYANWVQEKPDHLFTGLIGGTSNRAPGVPVRFSGSLIGDKAALTITGAQTEDDAMYFSSLWYYGGHGVFG

SEQ ID NO: 305 - protein, 107 aa, Artificial Sequence
  Synthesized sequence with two or more selenocysteine residues substituted for two or more cysteine residues
  VARIANT (1)...(107): Xaa = selenocysteine or cysteine
SIVMTQTPKFLLVSAGDRITIAXRASQSVSNDVAWYQQKPGQSPKLLINYTSNRYTGVPDRFTGSGYGTDFTFTISTVQAEDLAVYFXQQAYSSPWTFGGGTKLEIK

SEQ ID NO: 306 - protein, 107 aa, Artificial Sequence
  Synthesized sequence with two or more selenocysteine residues substituted for two or more cysteine residues
  VARIANT (1)...(107): Xaa = selenocysteine or cysteine
DIVMTQSPATLSVTPGDRVSLSXRASQSISDYLHWYQQKSHESPRLLIRYASQSISGIPSRFSGSGSGSDFTLSINNVEPEDVGVYYXQNGHNFPLTFGAGTKLELK

SEQ ID NO: 307 - protein, 107 aa, Artificial Sequence
  Synthesized sequence with two or more selenocysteine residues substituted for two or more cysteine residues
  VARIANT (1)...(107): Xaa = selenocysteine or cysteine
DVQITQSPSYLAASPGETITINXRASKSISKYLAWYQEKPGKTNKLLIYSGSTLQSGIPSRFSGSGSGTDFTLTISSLEPEDFAMYYXQQHHEYPYTFGGGTKLEIK

SEQ ID NO: 308 - protein, 108 aa, Artificial Sequence
  Synthesized sequence with two or more selenocysteine residues substituted for two or more cysteine residues
  VARIANT (1)...(108): Xaa = selenocysteine or cysteine
DIQLTQSPSSLSASVGDRVTITXQASQDISNYLNWYQQKPGKAPKLLMYDASNLETGVPSRFSGSGSGTDFTFTISSLQPEDFATYYXQQSDNLPYTFGQGTKVDIKR

SEQ ID NO: 309 - protein, 97 aa, Artificial Sequence
  Synthesized sequence with two or more selenocysteine residues substituted for two or more cysteine residues
  VARIANT (1)...(97): Xaa = selenocysteine or cysteine
ASLAVSLGQRATISXRASESVDNYGISFMNWFQQKPGQPPKLLIYAASNQGSGVPARFSGSGSGTDFSLNIHPMEGDDSAMYFXQQSKEVPRTRSEG

SEQ ID NO: 310 - protein, 112 aa, Artificial Sequence
  Synthesized sequence with two or more selenocysteine residues substituted for two or more cysteine residues
  VARIANT (1)...(112): Xaa = selenocysteine or cysteine
DVVMTQSPLSLPVTLGEPASISXRSSQSLVHSNGNTYLHWYLQKPGQSPQLLIYKVSNRFSGVPDRFSGSGSGTDFTLKISRVEAEDVGVYFXSQSTLVPLTFGQGTKLEIK

SEQ ID NO: 311 - protein, 106 aa, Artificial Sequence
  Synthesized sequence with two or more selenocysteine residues substituted for two or more cysteine residues
  VARIANT (1)...(106): Xaa = selenocysteine or cysteine
DIELTQPPSVSVAPGQTARISXSGDSIGKKYAYWYQQKPGQAPVLVIYKKRPSGIPERFSGSNSGNTATLTISGTQAEDEADYYXSAWGDKGMVFGGGTKLTVLGQ

SEQ ID NO: 312 - protein, 112 aa, Artificial Sequence
  Synthesized sequence with two or more selenocysteine residues substituted for two or more cysteine residues
  VARIANT (1)...(112): Xaa = selenocysteine or cysteine
DVVLTQTPLSLPVSLGDQASISXRVSQSLLHSNGYTYLHWYLQKPGQSPKLLIYKVSNRFSGVPDRFSGSGSGTDFTLKISRVEAEDLGVYFXSQTRHVPYTFGGGTKLEIK

SEQ ID NO: 313 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXRASQDVSTAVAWYQQKPGKAPKLLIYSASFLYSGVPSRFSGSGSGTDFTLTISSLQPEDFATYYXQQFPTYLPTFGQGTKVEIKR

SEQ ID NO: 314 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXRASESISYSLSWYQQKPGKAPKLLIYNAVKLESGVPSRFSGSGSGTDFTLTISSLQPEDFATYYXKQYWNTPFTFGQGTKVEIKR

SEQ ID NO: 315 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXRASQDVSTAVAWYQQKPGKAPKLLIYSASFLYSGVPSRFSGSGSGTDFTLTISSLQPEDFATYYXQQSYTTPPTFGQGTKVEIKR

SEQ ID NO: 316 - protein, 111 aa, Artificial Sequence
  Synthesized sequence with two or more selenocysteine residues substituted for two or more cysteine residues
  VARIANT (1)...(111): Xaa = selenocysteine or cysteine
QPVLTQSPSASASLGNSVKITXTLSSQHSTYTIGWYQQHPDKAPKYVMYVNSDGSHSKGDGIPDRFSGSSSGAHRYLSISNIQPEDEADYFXGSSDSSGYVFGSGTQLTVL

SEQ ID NO: 317 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQTTSSLSASLGDRVTISXSASQGISNYLNWYQQKPDGNVKLLIYYTSSLHSGVPSRFSGSGSGTDYSLTISNLEPEDIATYYXQQYSKLPYTFGGGTKLEIK

SEQ ID NO: 318 - protein, 114 aa, Artificial Sequence
  Synthesized sequence with two or more selenocysteine residues substituted for two or more cysteine residues
  VARIANT (1)...(114): Xaa = selenocysteine or cysteine
DIQMTQSPSSLSASVGDRVTITXRSSQSLVHGIGNTYLHWYQQKPGKAPKLLIYYKVSNRFSGVPSRFSGSGSGTDFTLTISSLQPEDFATYYXSQSTHVPLTFGQGTKVEIKR

SEQ ID NO: 319 - protein, 114 aa, Artificial Sequence
  Synthesized sequence with two or more selenocysteine residues substituted for two or more cysteine residues
  VARIANT (1)...(114): Xaa = selenocysteine or cysteine
EIVLTQSPAITAASLGQKVTITXSASSSVSYMHWYQQKSGTSPKPWIYEISKLASGVPARFSGSGSGTSYSLTISSMEAEDAAIYYXQQWNYPLITFGSGTKLEIKRADAAPTV

SEQ ID NO: 320 - protein, 108 aa, Artificial Sequence
  Synthesized sequence with two or more selenocysteine residues substituted for two or more cysteine residues
  VARIANT (1)...(108): Xaa = selenocysteine or cysteine
ETVLTQSPGTLSLSPGERATLSXRASQSLGSSYLAWYQQKPGQAPRLLIYGASSRAPGIPDRFSGSGSGTDFTLTISRLEPEDFAVYYXQQYADSPITFGQGTRLEIK

SEQ ID NO: 321 - protein, 111 aa, Artificial Sequence
  Synthesized sequence with two or more selenocysteine residues substituted for two or more cysteine residues
  VARIANT (1)...(111): Xaa = selenocysteine or cysteine
DWMTQTPLNLSVTIGQPASISXKSSQSLLDRDGKTYLNWLFQRPGQSPKRLIYLVSKLDSGVPDRFTGSGSGTDFTLKISRVEAEDLGVYYXWQGTHFPRTFGGGTKLEIK

SEQ ID NO: 322 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPATLSLSPGERATLSXRASKSISKYLAWYQQKPGQAPRLLIYSGSTLQSGIPARFSGSGSGTDFTLTISSLEPEDFAVYYXQQHNEYPYTFGQGTKLEIKR

SEQ ID NO: 323 - protein, 110 aa, Artificial Sequence
  Synthesized sequence with two or more selenocysteine residues substituted for two or more cysteine residues
  VARIANT (1)...(110): Xaa = selenocysteine or cysteine
QSVLTQPPSASGTPGQRATISXTGSSSNIGSNSVSWYQQLPGTAPKLLIYANSNRPSGVPDRFSGSKSGTSASLAISGLRSEDEADYYXGTWDASLSAYVFGGGTKLTVL

SEQ ID NO: 324 - protein, 108 aa, Artificial Sequence
  Synthesized sequence with two or more selenocysteine residues substituted for two or more cysteine residues
  VARIANT (1)...(108): Xaa = selenocysteine or cysteine
DIVLTQSPASLAVSLGQRATISYRASKSVSTSGYSYMHWNQQKPGQPPRLLIYLVSNLESGVPARFSGSGSGTDFTLNIHPVEEEDAATYYXQHIRELTRSEGGPSWK

SEQ ID NO: 325 - protein, 105 aa, Artificial Sequence
  Synthesized sequence with two or more selenocysteine residues substituted for two or more cysteine residues
  VARIANT (1)...(105): Xaa = selenocysteine or cysteine
SIVMTQTPKFLLVSAGDRVTITXKASQSVSNDVTWYQQKAGQSPKLLIYSASNRYSGVPDRFTGSGYGTAFTFTISTVQAEDLAVYFXQQDYSSFGGGTKLEIKR

SEQ ID NO: 326 - protein, 112 aa, Artificial Sequence
  Synthesized sequence with two or more selenocysteine residues substituted for two or more cysteine residues
  VARIANT (1)...(112): Xaa = selenocysteine or cysteine
DIVMTQSPLSLPVTPGEPASISXRSSQSIVYSNGNTYLGWYLQKPGQSPQLLIYKVSNRFSGVPDRFSGSGSGTDFTLKISRVEAEDVGVYYXFQGSHVPYTFGQGTKLEIK

SEQ ID NO: 327 - protein, 107 aa, Artificial Sequence
  Synthesized sequence with two or more selenocysteine residues substituted for two or more cysteine residues
  VARIANT (1)...(107): Xaa = selenocysteine or cysteine
EIVLTQSPGTLSLSPGERATLSXRASQSISSSYLAWYQQKPGQAPRLLIYGPSSRATGIPDRFSGSGSGTDFTLTISRLEPEDFAVYYXQQYAGSLTFGPGTKVDIK

SEQ ID NO: 328 - protein, 107 aa, Artificial Sequence
  Synthesized sequence with two or more selenocysteine residues substituted for two or more cysteine residues
  VARIANT (1)...(107): Xaa = selenocysteine or cysteine
EIVLTQSPATLSLSPGERATLSXRASQSVGRYLAWYQQKPGQAPRILIYGASNRATGIPARFSGSGSGTDFTLTISSLEPEDFAVYYXQQRSNWPLTFGGGTKVEIK

SEQ ID NO: 329 - protein, 113 aa, Artificial Sequence
  Synthesized sequence with two or more selenocysteine residues substituted for two or more cysteine residues
  VARIANT (1)...(113): Xaa = selenocysteine or cysteine
EIVLTQSPGSLAVSPGERVTMSXKSSQSVFFSSSQKNYLAWYQQIPGQSPRLLIYWASTRESGVPDRFTGSGSGTDFTLTISSVQPEDLAIYYXHQYLSSRTFGQGTKLEIKR

SEQ ID NO: 330 - protein, 108 aa, Artificial Sequence
  Synthesized sequence with two or more selenocysteine residues substituted for two or more cysteine residues
  VARIANT (1)...(108): Xaa = selenocysteine or cysteine
DIQLTQSPSSLSASVGDRVTITXRASENIYSNLAWYRQKPGKAPKLLVFAASNLADGVPSRFSGSGSGTDYTFTISSLQPEDIATYYXQHFWTTPWAFGGGTKLQIKR

SEQ ID NO: 331 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXKTNENIYSNLAWYQQKDGKSPQLLIYAATHLVEGVPSRFSGSGSGTQYSLTISSLQPEDFGNYYXQHFWGTPXTFGGGTKLEIKR

SEQ ID NO: 332 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSSSSFSVSLGDRVTITXKASEDIYNRLAWYQQKPGNAPRLLISGATSLETGVPSRFSGSGSGKDYTLSITSLQTEDVASYYXQQYWSTPFTFGSGTKLEIK

SEQ ID NO: 333 - protein, 113 aa, Artificial Sequence
  Synthesized sequence with two or more selenocysteine residues substituted for two or more cysteine residues
  VARIANT (1)...(113): Xaa = selenocysteine or cysteine
DIQMTQSPSSLSASVGDRVTITXRSSQNLVHSNGNTYLHWYQQKPGKAPKLLIYKVSNRFSGVPDRFSGSGSGTEFTLTISSLQPEDFATYYXSQSTHVPLTFGQGTKVEIKR

SEQ ID NO: 334 - protein, 112 aa, Artificial Sequence
  Synthesized sequence with two or more selenocysteine residues substituted for two or more cysteine residues
  VARIANT (1)...(112): Xaa = selenocysteine or cysteine
DIVLTQSPASLAVSLGQRATISXRASESVDSYGNSFMHWYQQKPGQPPKLLIYRASNLESGIPARFSGSGSRTDFTLTINPVEADDVATYYXQQSNEDPLTFGAGTKLELKR

SEQ ID NO: 335 - protein, 112 aa, Artificial Sequence
  Synthesized sequence with two or more selenocysteine residues substituted for two or more cysteine residues
  VARIANT (1)...(112): Xaa = selenocysteine or cysteine
DIQLTQSPSSLSASVGDRVTITXKASQSVDYDGDSYLNWYQQIPGKAPKLLIYDASNLVSGIPPRFSGSGSGTDYTFTISSLQPEDIATYHXQQSTEDPWTFGGGTKLQIKR

SEQ ID NO: 336 - protein, 108 aa, Artificial Sequence
  Synthesized sequence with two or more selenocysteine residues substituted for two or more cysteine residues
  VARIANT (1)...(108): Xaa = selenocysteine or cysteine
DIQLTQSPSSLSASVGDRVTITXKASQEVGTAVAWYQQKPGKAPKLLIYWASTRHTGVPSRFSGSGSGTDFTFTISSLQPEDIATYFXQQYSNYPLTFGQGTKVEIKR

SEQ ID NO: 337 - protein, 107 aa, Artificial Sequence
  Synthesized sequence with two or more selenocysteine residues substituted for two or more cysteine residues
  VARIANT (1)...(107): Xaa = selenocysteine or cysteine
DIQLTQSPALMSASPGEKVTMTXSASSSVTFMYWYQQKPRSSPKPWIYLTSNLASGVPARFSGSGSGTSYSLTISSMEAEDAATYYXQQWSSNPYTFGGGTKLELKR

SEQ ID NO: 338 - protein, 107 aa, Artificial Sequence
  Synthesized sequence with two or more selenocysteine residues substituted for two or more cysteine residues
  VARIANT (1)...(107): Xaa = selenocysteine or cysteine
QAVVTQESAFTTSPGGTVILTXRSSTGAVTTNNYANWVQEKPDHLFTGLIGGTSNRAPGVPVRFSGSLIGDKAALTITGAQTEDDGMYFXALWYTTHFVFGGGTKVT

SEQ ID NO: 339 - protein, 107 aa, Artificial Sequence
  Synthesized sequence with two or more selenocysteine residues substituted for two or more cysteine residues
  VARIANT (1)...(107): Xaa = selenocysteine or cysteine
ENVLTQSPAIMSASLGEKVTLSXRASSSVYYMFWYQQKSDASPKLWIYYTSNLAPGVPARFSGSGSGNSYSLTISSVEGEDAATYYXLQFSTSPWTFGGGTKLEIKR

SEQ ID NO: 340 - protein, 102 aa, Artificial Sequence
  Synthesized sequence with two or more selenocysteine residues substituted for two or more cysteine residues
  VARIANT (1)...(102): Xaa = selenocysteine or cysteine
DIVMTQSPDSLAVSLGERATINXKSSQSVLGSSSNINFLAWYQQKPGQPPKLLIYSASTRESGVPDRFSGSGSGTDFTLTISSLQAEDVAVYYXQQYFSTPI

SEQ ID NO: 341 - protein, 113 aa, Artificial Sequence
  Synthesized sequence with two or more selenocysteine residues substituted for two or more cysteine residues
  VARIANT (1)...(113): Xaa = selenocysteine or cysteine
DIVMTQSPDSLAVSLGERATINXKSSQSLLYSTNQKNSLAWYQQKPGQPPKLLIYWASTRESGVPDRFSGSGSGTDFTLTISSLQAEDVAVYYXQQYYRYPLTFGQGTKLEIK

SEQ ID NO: 342 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTITXRASQTIYNYLNWYQQKPGKAPKLLIYAASSLQSGVPSRFGGRGYGTDFTLTINSLQPEDFATYFXQQSYTSPLTFGQGTKVDIK

SEQ ID NO: 343 - protein, 114 aa, Artificial Sequence
  Synthesized sequence with two or more selenocysteine residues substituted for two or more cysteine residues
  VARIANT (1)...(114): Xaa = selenocysteine or cysteine
SQSALTQPASVSGSPGQSITISXTGTISDIGTYDFVSWYQHKPGKAPKLLIFDVNNRPSGVSSRFSGSKSDNTASLSISGFQAEDEADYYXSSYTDNRGLVLFGGGTKLTVLRS

SEQ ID NO: 344 - protein, 112 aa, Artificial Sequence
  Synthesized sequence with two or more selenocysteine residues substituted for two or more cysteine residues
  VARIANT (1)...(112): Xaa = selenocysteine or cysteine
DVLMTQTPLSLPVSLGDQASISXRSSQSIVHSNGNTYLEWYLQKTGQSPELLIYKVSNRLSGVPDRFSGSGSGTDFTLKISRVEAEDLGVYYXFQGSHVPFTFGSGTKLEIK

SEQ ID NO: 345 - protein, 112 aa, Artificial Sequence
  Synthesized sequence with two or more selenocysteine residues substituted for two or more cysteine residues
  VARIANT (1)...(112): Xaa = selenocysteine or cysteine
DVVMTQSPLSLPVTLGQPASISXRSSQSLLISGGKTYLNWFQQRPGQSPARLIYLVSKLDQGVPDRFSGSGSGTDFTLKISRVEAEDVGVYYXWQGTYFPLTFGQGTKLEIK

SEQ ID NO: 346 - protein, 107 aa, Artificial Sequence
  Synthesized sequence with two or more selenocysteine residues substituted for two or more cysteine residues
  VARIANT (1)...(107): Xaa = selenocysteine or cysteine
AIQLTQSPSSLSASVGDRVTITXRASQGISNALAWYQQKPGKAPKLLIYDASSLESGVPSRFSGSGSGTDFTLTISSLQPEDFATYYXQQFNSYPWTFGQGTKVEIK

SEQ ID NO: 347 - protein, 110 aa, Artificial Sequence
  Synthesized sequence with two or more selenocysteine residues substituted for two or more cysteine residues
  VARIANT (1)...(110): Xaa = selenocysteine or cysteine
LETTLTQSPDTLSLSPGEGATLSXRASQSVSGSALAWYQQKPGQAPRLLIYDASSRATGVPDRFSGSGSGADFSLTISRLEPEDFAVYSXQQYGSSPLTFGPGTKVDVKR

SEQ ID NO: 348 - protein, 110 aa, Artificial Sequence
  Synthesized sequence with two or more selenocysteine residues substituted for two or more cysteine residues
  VARIANT (1)...(110): Xaa = selenocysteine or cysteine
QTVVTQEPSLTVSPGGTVTLTXRSSTGAVTTSNYANWVQQKPGQAFRGLIGDTNNRAPWTPARFSGSLLGGKAALTLSGVQPEDEAEYYXALWYSNHFIFGSGTKVTVLG

SEQ ID NO: 349 - protein, 107 aa, Artificial Sequence
  Synthesized sequence with two or more selenocysteine residues substituted for two or more cysteine residues
  VARIANT (1)...(107): Xaa = selenocysteine or cysteine
EIVLTQSPATLSLSPGERATLSXRASKSISKYLAWYQQKPGQAPRLLIYSGSTLQSGIPARFSGSGSGTDFTLTISSLEPEDFAVYYXQQHDYPYTFGQGTKLEIKR

SEQ ID NO: 350 - protein, 112 aa, Artificial Sequence
  Synthesized sequence with two or more selenocysteine residues substituted for two or more cysteine residues
  VARIANT (1)...(112): Xaa = selenocysteine or cysteine
DIVMTQSPLSLPVTPGEPASISXRSSQSIVHSNGNTYLEWYLQKPGQSPQLLISKVSNRFSGVPDRFSGSGSGTDFTLKISRVEAEDVGVYYXFQGSHVPFTFGQGTKLEIK

SEQ ID NO: 351 - protein, 109 aa, Artificial Sequence
  Synthesized sequence with two or more selenocysteine residues substituted for two or more cysteine residues
  VARIANT (1)...(109): Xaa = selenocysteine or cysteine
DIVLTQSPAFLSVTPGEKVTFTXQASQSIGTSIHWYQQKTDQAPKLLIKYASESISGIPSRFSGSGSGTDFTLTISSVEAEDAADYYXQQINSWPTTFGGGTKLEIKRT

SEQ ID NO: 352 - protein, 109 aa, Artificial Sequence
  Synthesized sequence with two or more selenocysteine residues substituted for two or more cysteine residues
  VARIANT (1)...(109): Xaa = selenocysteine or cysteine
EIVLTQSPGTLSLSPGERATLSXRASQSITGSYLAWYQQKPGQAPRLLITGASSWATGIPDRFSGSGSGTDFTLTISRLEPEDFAVYYXQQYSSSPITFGQGTRLEIKR

SEQ ID NO: 353 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXRASQSISTWLAWYQQKPGKAPKLLIYKASNLHTGVPSRFSGSGSGTEFSLTISGLQPDDFATYYXQQYNSYSRTFGQGTKVEIKR

SEQ ID NO: 354 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSVSASVGDRVTITXRASQGISRLLAWYQQKPGKAPKLLIYVASSLQSGVPSRFSGSGSGTDFTLTISSLQPEDFATYYXQQANSFPWTFGQGTKVEIK

SEQ ID NO: 355 - protein, 111 aa, Artificial Sequence
  Synthesized sequence with two or more selenocysteine residues substituted for two or more cysteine residues
  VARIANT (1)...(111): Xaa = selenocysteine or cysteine
QSVLTQPPSVSAAPGQKVTISXSGGGSSIGNSYVSWYQQLPGTAPKLLIYDNNKRPSGIPDRFSGSKSGTSATLGITGLQTGDEADYYXGTWDTSPVWEWPFGTGTKLTVL

SEQ ID NO: 356 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXKASQSVGSDVAWYQQKPGKAPKLLIYSTSYRYSGVPSRFSGSGSGTDFTLTISSLQPEDFATYYXQQYSSYPFTFGQGTKVEIKR

SEQ ID NO: 357 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSTSVGDRVTLTXKASQDVGTAVDWYQQKPGPSPKLLIYWASTRHTGIPSRFSGSGSGTDFTLTISSLQPEDFADYYXQQYNSYPLTFGPGTKVDIK

SEQ ID NO: 358 - protein, 111 aa, Artificial Sequence
  Synthesized sequence with two or more selenocysteine residues substituted for two or more cysteine residues
  VARIANT (1)...(111): Xaa = selenocysteine or cysteine
QSALTQPASVSGSPGQSITISXTGTSSDVGSYNVVSWYQQHPGKAPKLIIYEVSQRPSGVSNRFSGSKSGNTASLTISGLQTEDEADYYXXSYAGSSIFVIFGGGTKVTVL

SEQ ID NO: 359 - protein, 106 aa, Artificial Sequence
  Synthesized sequence with two or more selenocysteine residues substituted for two or more cysteine residues
  VARIANT (1)...(106): Xaa = selenocysteine or cysteine
SYELTQPPSVSVAPGQTARISXSGDSLGSYFVHWYQQKPGQAPVLVIYDDSNRPSGIPERFSGSNSGNTATLTISGTQAEDEADYYXSAFTHNSDVFGGGTKLTVL

SEQ ID NO: 360 - protein, 108 aa, Artificial Sequence
  Synthesized sequence with two or more selenocysteine residues substituted for two or more cysteine residues
  VARIANT (1)...(108): Xaa = selenocysteine or cysteine
DIELTQPPSVSVAPGQTARISXSGDNLRHYYWWYQQKPGQAPVLVIYGDSKRPSGIPERFSGSNSGNTATLTISGTQAEDEADYYXQTYTGGASLVFGGGTKLTVLGQ

SEQ ID NO: 361 - protein, 107 aa, Artificial Sequence; identical to SEQ ID NO: 268
  Synthesized sequence with two or more selenocysteine residues substituted for two or more cysteine residues
  VARIANT (1)...(107): Xaa = selenocysteine or cysteine

SEQ ID NO: 362 - protein, 109 aa, Artificial Sequence
  Synthesized sequence with two or more selenocysteine residues substituted for two or more cysteine residues
  VARIANT (1)...(109): Xaa = selenocysteine or cysteine
DIQMTQSPSSLSASVGDRVTITXSASSSINSNHLHWYQQKPGKAPKLLIYRTSILASGVPSRFSGSGSGTSFTLTISSLQPEDFATYYXQQGSNIPFTFGQGTKVEIKR

SEQ ID NO: 363 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASLGERVSLTXRASQDIGSNLNWLQQEPDGTIKRLIYATSSLDSGVPKRFSGSRSGSDYSLTISSLESEDFVDYYXLQYASSPPTFGGGTKLEIKR

SEQ ID NO: 364 - protein, 109 aa, Artificial Sequence
  Synthesized sequence with two or more selenocysteine residues substituted for two or more cysteine residues
  VARIANT (1)...(109): Xaa = selenocysteine or cysteine
SSELTQDPAVSVALGQTVRITXRGDSLRKYYASWYQQKPRQAPQLVIYHKNNRASGIPDRFSGSISGNTASLTITGAQAEDEAAYFXNSRDTSGNYLVFGGGTKVTVLG

SEQ ID NO: 365 - protein, 112 aa, Artificial Sequence
  Synthesized sequence with two or more selenocysteine residues substituted for two or more cysteine residues
  VARIANT (1)...(112): Xaa = selenocysteine or cysteine
DVVMTQSPLSLPVTPGEPASISXRSSQSIVHSNGNTYLEWYLQKPGQSPQLLIYKASNRFSGVPDRFSGSGSGTDFTLKISRVEAEDVGVYYXFQGSRLGPSFGQGTKLEIK

SEQ ID NO: 366 - protein, 111 aa, Artificial Sequence
  Synthesized sequence with two or more selenocysteine residues substituted for two or more cysteine residues
  VARIANT (1)...(111): Xaa = selenocysteine or cysteine
DIVLTQSPASLAVSLGQRATISXRASESVGNFGISFMNWFQQKPGQPPKLLIYTASNQGSGVPARFSGSGSGTDFSLNIHPMEEDDSAMYFXQQSKEIPWTFGGGTKLEIK

SEQ ID NO: 367 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTITXRASQGIRSALNWYQQKPGKAPKLLIYNGSTLQSGVPSRFSGSGSGTDFTLTISSLQPEDFAVYYXQQFDGDPTFGQGTKVEIKR

SEQ ID NO: 368 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXRASQTIWSYLNWYQQRPGKAPNLLIYAASSLQSGVPSRFSGRGSGTDFTLTISSLQAEDFATYYXQQSYSIPQTFGQGTKLEIKR

SEQ ID NO: 369 - protein, 109 aa, Artificial Sequence
  Synthesized sequence with two or more selenocysteine residues substituted for two or more cysteine residues
  VARIANT (1)...(109): Xaa = selenocysteine or cysteine
RIVMTQSPGTLSVSPGETATLSXRASQSFSNMLAWYQQKSGQPPRLLIYGVSTRAAGVPARFSGSGSGTEFTLTISNLQSEDFAVYYXQQYGDWPRYTFGQGTKVERKR

SEQ ID NO: 370 - protein, 108 aa, Artificial Sequence
  Synthesized sequence with two or more selenocysteine residues substituted for two or more cysteine residues
  VARIANT (1)...(108): Xaa = selenocysteine or cysteine
SYVLTQPPSVSVAPGQTARITXGGNNIESKSVHWYQQKPGQAPVLVVYDDSDRPSGIPERFSGSNSGNTATLTISRVEAGDEADYYXQVWDSNTDHWVFGGGTKLTVL

SEQ ID NO: 371 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTITXKASQDINKYIAWYQQKPGKAPKLLIHYTSTLQPGIPSRFSGSGSGRDYTFTISSLQPEDIATYYXLQYDNLLFTFGQGTKLEIK

SEQ ID NO: 372 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSTLSASIGDRVTITXRASEGIYHWLAWYQQKPGKAPKLLIYKASSLASGAPSRFSGSGSGTDFTLTISSLQPDDFATYYXQQYSNYPLTFGGGTKLEIK

SEQ ID NO: 373 - protein, 112 aa, Artificial Sequence
  Synthesized sequence with two or more selenocysteine residues substituted for two or more cysteine residues
  VARIANT (1)...(112): Xaa = selenocysteine or cysteine
DIELTQSPASLAVSLGQRATISXKASQSVDYDGDSYLNRFQQKPGQPPKLLIYTASNLESGIPARFSGSGSGTDFTLNIHPVEEEDAATYYXQQSNEDPWTFGGGTKLEIKR

SEQ ID NO: 374 - protein, 113 aa, Artificial Sequence
  Synthesized sequence with two or more selenocysteine residues substituted for two or more cysteine residues
  VARIANT (1)...(113): Xaa = selenocysteine or cysteine
DVLLTQTPLTLSITIGQPASISXKSSQSLLHSDGKTYLNWLLQRPGQSPKRLIYLVSKLDSGVPDRFTGSGSGTDFTLKISRVEAEDLGLYYXWQGTHFPQTFGGGTKLEIKR

SEQ ID NO: 375 - protein, 107 aa, Artificial Sequence
  Synthesized sequence with two or more selenocysteine residues substituted for two or more cysteine residues
  VARIANT (1)...(107): Xaa = selenocysteine or cysteine
DILLTQSPATLSLSPGERATLSXRASQNIGTSIQWYQQKPGQAPRLLIRSSSESISGIPSRFSGSGSGTDFTLTISSLEPEDFAVYYXQQSNTWPFTFGQGTKLEIK

SEQ ID NO: 376 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQTTSSLSASLGDRVTISXRASQDISFFLNWYQQKPDGTVKLLIYYTSRYHSGVPSRFSGSGSGTDFSLTINNLEQEDFATYFXQHGNTLPWTFGGGTKLEIKR

SEQ ID NO: 377 - protein, 108 aa, Artificial Sequence
  Synthesized sequence with two or more selenocysteine residues substituted for two or more cysteine residues
  VARIANT (1)...(108): Xaa = selenocysteine or cysteine
DVQITQSPSYLAASPGETITINXRASKSISKYLAWYQEKPVKTNKLLIYSGSTLQSGIPSRFSGSGSGTDFTLTISSLEPEDFAMYYXQQHYEYPLTFGAGTKLELKR

SEQ ID NO: 378 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPGTLSLSPGERATLSXRASQSVSSSYLAWYQQKPGQAPRLLIYGASSRATGIPDRFSGSGSGTDFTLTISRLEPEDFAVYYXQQYGSSPWTFGQGTKVEIK

SEQ ID NO: 379 - protein, 108 aa, Artificial Sequence
  Synthesized sequence with two or more selenocysteine residues substituted for two or more cysteine residues
  VARIANT (1)...(108): Xaa = selenocysteine or cysteine
DIVMTQSHKFMSTSVGDRVSITXKASQDVSTAVAWYQQKPGQSPKLLIYLTSYRNTGVPDRFTGSGSGTDFTFTISSVQAEDLAVYYXQQHYKTPYSFGGGTKLERLR

SEQ ID NO: 380 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPASLSASVGETVTITXRASENIYSYLTWYQQKQRKSPQLLVYNAKTLAEGVPSRFSGSGSGTQFSLKINSLQPEDFGTYYXQHHYATPWTFGGGTKVEIK

SEQ ID NO: 381 - protein, 108 aa, Artificial Sequence
  Synthesized sequence with two or more selenocysteine residues substituted for two or more cysteine residues
  VARIANT (1)...(108): Xaa = selenocysteine or cysteine
QSQLTQPPSVSVAPGQTARITXGGDNIGSKSVNWFQQKPGQAPVLVVYDDNERPSGISERFSGSNSGNTATLTISRVEAGDEADYYXQVWDSSSDHVVFGGGTKLTVL

SEQ ID NO: 382 - protein, 107 aa, Artificial Sequence
  Synthesized sequence with two or more selenocysteine residues substituted for two or more cysteine residues
  VARIANT (1)...(107): Xaa = selenocysteine or cysteine
DIVMTQSHKFMSTSVGDRVSITXKASQDVGSAVAWYQQKPGQSPKLLIYWASTRHTGVPDRFTGSGSGTDFTLTISSLQSEDLADYFXQQYSSYPLTFGSGTKLEIK

SEQ ID NO: 383 - protein, 106 aa, Artificial Sequence
  Synthesized sequence with two or more selenocysteine residues substituted for two or more cysteine residues
  VARIANT (1)...(106): Xaa = selenocysteine or cysteine
DVVMTQTPLTLSVNIGQPASISXKSSQSLLYSNGKTYLNWLLQRPGQSPRRLIYQVSKLDSGVPDRFTGSGSGTDFTLKISRVEAEDLGVYYXVQGTDFPQTFGGG

SEQ ID NO: 384 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPASLSASVGDTVTITXRASENIYSFLAWYHQKQGRSPQLLVYHAKTLAEGVPSRFSGSGSGTQFSLKINSLQAEDFGSYYXQHYYGSPLTFGAGTKLEVKR

SEQ ID NO: 385 - protein, 109 aa, Artificial Sequence
  Synthesized sequence with two or more selenocysteine residues substituted for two or more cysteine residues
  VARIANT (1)...(109): Xaa = selenocysteine or cysteine
QIVLTQSPAIMSASLGERVTMTXTASSSVSSSYFHWYQQKPGSSPKLWIYSTSNLASGVPARFSGSGSGTSYSLTISTMEAEDAVTYYXHQYHRSPWTFGGGTKLEIKR

SEQ ID NO: 386 - protein, 96 aa, Artificial Sequence
  Synthesized sequence with two or more selenocysteine residues substituted for two or more cysteine residues
  VARIANT (1)...(96): Xaa = selenocysteine or cysteine
SYVLTQPPSVSVSPGQTASITXSGDKLGDKYAXWYQQKPGQSPVLVIYQDSKRPSGIPERFSGSNSGNTATLTISGTQAMDEADYYXQAWDSSIVV

SEQ ID NO: 387 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQTSSLSASLGDRVTISXRASQDISNYLNWYQQKPDGTVKFLIYYTSRLHSGVPSRFSGSGSGTDYSLTISYLEPEDIATYFXQQGEALPWTFGGGTKLEIKR

SEQ ID NO: 388 - protein, 111 aa, Artificial Sequence
  Synthesized sequence with two or more selenocysteine residues substituted for two or more cysteine residues
  VARIANT (1)...(111): Xaa = selenocysteine or cysteine
QSALTQPASVSGSPGQSITISXTGTSNDVGAYNYVSWYQQHPGKAPKLMISEVNKRPSGVSNRFSGSKSGNTASLTISGLQAEDEADYYXSSFTSGLPWVVFGGGTKLTVL

SEQ ID NO: 389 - protein, 113 aa, Artificial Sequence
  Synthesized sequence with two or more selenocysteine residues substituted for two or more cysteine residues
  VARIANT (1)...(113): Xaa = selenocysteine or cysteine
DIQMTQSPSSLSASVGDRVTITXKSIQTLLYSSNQKNYLAWYQQKPGKAPKLLIYWASIRKSGVPSRFSGSGSGTDFTLTISSLQPEDFATYYXQQYYSYPLTFGGGTKLEIK

SEQ ID NO: 390 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTITXKASQSVSNDVAWYQQKPGKAPKLLIYFATNRYTGVPSRFSGSGYGTDFTLTISSLQPEDFATYYXQQDYSSPWTFGQGTKVEIK

SEQ ID NO: 391 - protein, 109 aa, Artificial Sequence
  Synthesized sequence with two or more selenocysteine residues substituted for two or more cysteine residues
  VARIANT (1)...(109): Xaa = selenocysteine or cysteine
QAVVTQESALTTSPGETVTLTXRSSTGAVTTSNYANWVQEKPDHLFTGLIGGTNNRAPGIPARFSGSLIGDKAALTITGAQTEDEAIYFXALWYSNHWVFGGGTKLTVL

SEQ ID NO: 392 - protein, 111 aa, Artificial Sequence
  Synthesized sequence with two or more selenocysteine residues substituted for two or more cysteine residues
  VARIANT (1)...(111): Xaa = selenocysteine or cysteine
DIVLTQSPASLAVSLGQRATISXRASQSVSTSRYSYMHWYQQIQGQPPKLLIKYASNLESGVPARFSGSGSGTDFTLNIHPVEEEDTATYHXQHSWEIPYTFGGGTTLEIK

SEQ ID NO: 393 - protein, 112 aa, Artificial Sequence
  Synthesized sequence with two or more selenocysteine residues substituted for two or more cysteine residues
  VARIANT (1)...(112): Xaa = selenocysteine or cysteine
DIVMTQSPLSLPVTPGEPASISXRSSQSIVHSNGNTYLQWYLQKPGQSPQLLIYKVSNRLYGVPDRFSGSGSGTDFTLKISRVEAEDVGVYYXFQGSHVPWTFGQGTKVEIK

SEQ ID NO: 394 - protein, 114 aa, Artificial Sequence
  Synthesized sequence with two or more selenocysteine residues substituted for two or more cysteine residues
  VARIANT (1)...(114): Xaa = selenocysteine or cysteine
DIVLTQSPDSLAVSLGERATINXKSSQSVLYSSNNKNYLAWYQQKPGQPPKLLIYWASTRESGVPDRFSGSGSGTDFTPAISSLQAEDVAVYYXQQYYSTPQLTFGGGTKVDIK

SEQ ID NO: 395 - protein, 110 aa, Artificial Sequence
  Synthesized sequence with two or more selenocysteine residues substituted for two or more cysteine residues
  VARIANT (1)...(110): Xaa = selenocysteine or cysteine
NFMLTQDAAVSVALGQTVRITXQGDSLRSYYASWYQQKPGQAPVLVVYGKNNRPSGIPDRFSGSSSGNTASLTITGAQAEDEADYYXNSRDSSGNPWAFGGGTKVTVLAS

SEQ ID NO: 396 - protein, 108 aa, Artificial Sequence; identical to SEQ ID NO: 315
  Synthesized sequence with two or more selenocysteine residues substituted for two or more cysteine residues
  VARIANT (1)...(108): Xaa = selenocysteine or cysteine

SEQ ID NO: 397 - protein, 111 aa, Artificial Sequence
  Synthesized sequence with two or more selenocysteine residues substituted for two or more cysteine residues
  VARIANT (1)...(111): Xaa = selenocysteine or cysteine
EIVLTQSPGTLSLSPGERATLSXKASQSVSIGPIHLMHWYQQKPGQAPRLLIYGASNPESGIPDRFSGSGSGTDFTLTISRLEPEDFAVYYXQQGKESPRTFGQGTKLEIK

SEQ ID NO: 398 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSTLSASVGDRVIITXRASQRISSWLAWYQQKPGKAPNLLIYKASILESGVPSRFSGSGSGTEFTLTISSLQPDDFATYYXQQYNSYSYTFGQGTKLEIK

SEQ ID NO: 399 - protein, 107 aa, Artificial Sequence
  Synthesized sequence with two or more selenocysteine residues substituted for two or more cysteine residues
  VARIANT (1)...(107): Xaa = selenocysteine or cysteine
EIVLTQSPATLSLSPGERATLSXWASQSISRYLVWYQQKXGQAPRLLIYEASKRATGIPVRFSGSGSGTDFTLTISSLESEDFAVYYXQQRFNWPLTFGGGTKVEIK

SEQ ID NO: 400 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPGTLSLSPGERVTLSXRASQSVSSSYLAWYQQKPGQAPRLLIYGASSRATGIPDRFSGSGSGTDFTLTISRLEPEDFAVYYXQQYGSSPRTFGQGTKVEIK

SEQ ID NO: 401 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTITXQASQDISNYLNWYQQKPGKAPKLLINDASNLETGVPSRFSGSGSGTDFTFTISSLQPEDIATYYXQHYDSLPLTFGQGTRLEIK

SEQ ID NO: 402 - protein, 111 aa, Artificial Sequence
  Synthesized sequence with two or more selenocysteine residues substituted for two or more cysteine residues
  VARIANT (1)...(111): Xaa = selenocysteine or cysteine
DIVMTQTPLSSPVTLGQPASISXRSSQSLVHSDGNTYLSWLHQRPGQPPRLLIYKISNRFSGVPDRFSGSGAGTDFTLQISRVEAEDVGIYYXMQATQFPTFGGGTKVEIK

SEQ ID NO: 403 - protein, 110 aa, Artificial Sequence
  Synthesized sequence with two or more selenocysteine residues substituted for two or more cysteine residues
  VARIANT (1)...(110): Xaa = selenocysteine or cysteine
QPGLTQPPSVSVAPGQTARITXGGNNIGSKSVHWYQQKPGQAPVLVVYDDSDRPSGIPERFSGSNSGNTATLTISRVEAGDEADYYXQVWDSSSDHYVFGTGTKVTVLGQ

SEQ ID NO: 404 - protein, 108 aa, Artificial Sequence
  Synthesized sequence with two or more selenocysteine residues substituted for two or more cysteine residues
  VARIANT (1)...(108): Xaa = selenocysteine or cysteine
QDIELTQPPSVSVAPGQTARISXSGDSLGKKYAHWYQQKPGQAPVLVIYEDSNRPSGIPERFSGSNSGNTATLTISGTQAEDEADYYXQSYGYSSIVFGGGTKLTVLG

SEQ ID NO: 405 - protein, 113 aa, Artificial Sequence
  Synthesized sequence with two or more selenocysteine residues substituted for two or more cysteine residues
  VARIANT (1)...(113): Xaa = selenocysteine or cysteine
DVVMTQTPLSLPVSLGDQASISXRSGQSLVHSNGNTYLHWYLQKPGQSPKLLIYTVSNRFSGVPDRFSGSGSGSDFTLKISRVEAEDLGVYFXSQNTFVPWTFGGGTKLEIKR

SEQ ID NO: 406 - protein, 114 aa, Artificial Sequence
  Synthesized sequence with two or more selenocysteine residues substituted for two or more cysteine residues
  VARIANT (1)...(114): Xaa = selenocysteine or cysteine
DILMTQSPSSLTVSAGEKVTMSXKSSQSLLASGNQNNYLAWHQQKPGRSPKMLIIWASTRVSGVPDRFIGSGSGTDFTLTINSVQAEDLAVYYXQQSYSAPLTFGAGTKLELKR

SEQ ID NO: 407 - protein, 91 aa, Artificial Sequence
  Synthesized sequence with two or more selenocysteine residues substituted for two or more cysteine residues
  VARIANT (1)...(91): Xaa = selenocysteine or cysteine
DRVTITXRASQGINSAFAWYQQKPGKAPKLLIYDASSLESGVPSRFSGSGSGTDFTLTISSLQPEDFATYYXQQFNSYPLTFGGGTKVEIK

SEQ ID NO: 408 - protein, 111 aa, Artificial Sequence
  Synthesized sequence with two or more selenocysteine residues substituted for two or more cysteine residues
  VARIANT (1)...(111): Xaa = selenocysteine or cysteine
DIVLTQSPASLAVSLGQRATISXRASQSVSTSSYSYMHWYQQKPGQPPKLLIKYASNLESGVPARFSGSGSGTDFTLNIHPVEEEDTATYYXQHSWEIPYTFGGGTKLEIK

SEQ ID NO: 409 - protein, 112 aa, Artificial Sequence
  Synthesized sequence with two or more selenocysteine residues substituted for two or more cysteine residues
  VARIANT (1)...(112): Xaa = selenocysteine or cysteine
DVLMTQTPLSSPVTLGQPASISXRSSQSIIHSNGNTYLEWYLQKPGQSPQLLIYKVSNRFSGVPDRFTGSGSGTDFTLKISRVEAEDVGVYYXFQGSHVPWTFGQGTKLEIK

SEQ ID NO: 410 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXKASQNVGTNVVWYQQKPGKAPKALIHSASYRYSGVPSRFSGSGSGTDFTLTISSLQPEDFATYYXQQYKTYPYTFGQGTKVEIKR

SEQ ID NO: 411 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPGTLSLSPGERATLSXRASQPISISVHWYQQKPGQAPRLLIYFASQSISGIPDRFSGSGSGTDFTLTISRLEPEDFAVYYXQQTFSLPYTFGQGTKVEIKR

SEQ ID NO: 412 - protein, 108 aa, Artificial Sequence
  Synthesized sequence with two or more selenocysteine residues substituted for two or more cysteine residues
  VARIANT (1)...(108): Xaa = selenocysteine or cysteine
DILMTQSPSSMSVSLGDTVSITXHASQDINSNIGWLQQKPGKSFKGLIYHGTNLEDGVPSRFSGSGSGADYSLTISSLESEDFADYYXVQYAQFPWTFGGGTKLEIKR

SEQ ID NO: 413 - protein, 107 aa, Artificial Sequence
  Synthesized sequence with two or more selenocysteine residues substituted for two or more cysteine residues
  VARIANT (1)...(107): Xaa = selenocysteine or cysteine
QIVLSQSPVILSASPGEKVTMTXRASSSVSFMHWYQQKPGSSPKPWIYATSNLTSGVPTRFSGSGSGTSYSLTISRVEAEDAATYYXQQWSSNPFTFGSGTKLEIKR

SEQ ID NO: 414 - protein, 112 aa, Artificial Sequence
  Synthesized sequence with two or more selenocysteine residues substituted for two or more cysteine residues
  VARIANT (1)...(112): Xaa = selenocysteine or cysteine
DVVMTQSPLSLPVTLGQPASISXRSSQSIVHSDGNTYLEWYQQRPGQSPRRLIYKVSNRFSGVPDRFSGSGSGTDFTLKISRVEAEDVGVYYXFQGSHAPWTFGGGTKVEIK

SEQ ID NO: 415 - protein, 110 aa, Artificial Sequence
  Synthesized sequence with two or more selenocysteine residues substituted for two or more cysteine residues
  VARIANT (1)...(110): Xaa = selenocysteine or cysteine
DIVITQDELSNPVIFGESVSISXRSSKSLLYKDGKTYLNWYLQRPGQSPQLLIYLMSTRASGVSDRFSGSGSGTDFTLEISRVKAEDVGVYYXQQVVEYPFTFGSGTKWK

SEQ ID NO: 416 - protein, 109 aa, Artificial Sequence
  Synthesized sequence with two or more selenocysteine residues substituted for two or more cysteine residues
  VARIANT (1)...(109): Xaa = selenocysteine or cysteine
QIVLTQSPAIMSASLGERVTMTXTASSSVSSSYLHWYQQKPGSSPKLWIYSTSNLASGVPARFSGSGSGTFYSLTISSMEAEDDATYYXHQYYRLPPITFGAGTKLELK

SEQ ID NO: 417 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPASQSASLGESVTITXLASQTIDTWLAWYQQKPGKSPQLLIYAATNLADGVPSRFSGSGSGTKFSFKISSLQAEDFVNYYXQQVYSSPFTFGAGTKLELK

SEQ ID NO: 418 - protein, 107 aa, Artificial Sequence
  Synthesized sequence with two or more selenocysteine residues substituted for two or more cysteine residues
  VARIANT (1)...(107): Xaa = selenocysteine or cysteine
QIVLTQSPAIMSASPGEKVTMTXSASSSVSYMHWYQQKSGTSPKRWIYDTSKLASGVPARFSGSGSGTSYSLTISSMEAEDAATYYXQQWSSNPFTFGSGTKLEIKR

SEQ ID NO: 419 - protein, 106 aa, Artificial Sequence
  Synthesized sequence with two or more selenocysteine residues substituted for two or more cysteine residues
  VARIANT (1)...(106): Xaa = selenocysteine or cysteine
QIVLSQSPAILSASPGEKVTMTXRASSSVSYMHWYQQKPGSSPKPWIYAPSNLASGVPARFSGSGSGTSYSLTISRVEAEDAATYYXQQWSFNPPTFGAGTKLELK

SEQ ID NO: 420 - protein, 105 aa, Artificial Sequence
  Synthesized sequence with two or more selenocysteine residues substituted for two or more cysteine residues
  VARIANT (1)...(105): Xaa = selenocysteine or cysteine
AALTQPSSVSANPGETVKITXSGGSGYYGWYQQQKSPGSAPVTVIYQNDKRPSDIPSRFSGSGSGSTNTLTITGVQAEDEAVYFXGRYDSTDSGIFGAGTTLTVL

SEQ ID NO: 421 - protein, 107 aa, Artificial Sequence
  Synthesized sequence with two or more selenocysteine residues substituted for two or more cysteine residues
  VARIANT (1)...(107): Xaa = selenocysteine or cysteine
DIVMTQSTSSLSASLGDRVTISXRASQDISNYLNWYQQKPDGTVKLLIYYTSRLHSGVPSRFSGSGSGTDYSLTISNLEQEDIATYFXQQGNTLPYTFGGGTKLEIK

SEQ ID NO: 422 - protein, 107 aa, Artificial Sequence
  Synthesized sequence with two or more selenocysteine residues substituted for two or more cysteine residues
  VARIANT (1)...(107): Xaa = selenocysteine or cysteine
ELQMTQSPSSVSASVGDRVTITXRASSSVSYLAWYQQKPGKAPKLLLNGTSSLQSGVPSRFSGSGSGTDFTLTISSLQPEDFATYYXQQRSSYPFTFGGGTKVEIKR

SEQ ID NO: 423 - protein, 113 aa, Artificial Sequence
  Synthesized sequence with two or more selenocysteine residues substituted for two or more cysteine residues
  VARIANT (1)...(113): Xaa = selenocysteine or cysteine
DIQMTQSPSSLSASVGDRVTITXRSSQTLVHSNGNTFLHWYQQKPGKAPKLLIYKVSNRFSGVPSRFSGSGSGTDYTFTISSLQPEDIATYYXSQGTHAPFTFGQGTKVEIKR

SEQ ID NO: 424 - protein, 113 aa, Artificial Sequence
  Synthesized sequence with two or more selenocysteine residues substituted for two or more cysteine residues
  VARIANT (1)...(113): Xaa = selenocysteine or cysteine
DIVMTQAAFSNPVTLGTSASISXRSSKSLLHSNGITYLYWYLQKPGQSPQVLIYQMSNLASGVPDRFSSSGSGTDFTLRISRVEAEDVGVYYXAQNLELPWTFGGGTKLEIKR

SEQ ID NO: 425 - protein, 108 aa, Artificial Sequence
  Synthesized sequence with two or more selenocysteine residues substituted for two or more cysteine residues
  VARIANT (1)...(108): Xaa = selenocysteine or cysteine
DIVLTQSPSSMSASLGDRVTITXQASQDIGNNLIWFQQKPGKSPRPMIYYATNLANGVPSRFSGSGSGTSYSLTISSMEAEDAATYYXQQWSSNPYTFGGGTKLEIKR

SEQ ID NO: 426 - protein, 107 aa, Artificial Sequence
  Synthesized sequence with two or more selenocysteine residues substituted for two or more cysteine residues
  VARIANT (1)...(107): Xaa = selenocysteine or cysteine
QVVLSQSPAILSASPGERVTLTXRASSSVNYMHWYQQKPGSSPKAWIYATSNLASGVPDRFSASGSGTSYSLTISRVEAEDAATYYXQQWRTNPPTFGAGTKLELKR

SEQ ID NO: 427 - protein, 112 aa, Artificial Sequence
  Synthesized sequence with two or more selenocysteine residues substituted for two or more cysteine residues
  VARIANT (1)...(112): Xaa = selenocysteine or cysteine
DVVMTQTPLSLPVSLGDQASFSXRSSQSLVHSNGNTYLHWYLQKPGQSPKLLIYKVSNRFSGVPDRFSGSGSGTDFTLKISRVEAEDLGVYFXSQSTHVPTFGGGTKLEIKR

SEQ ID NO: 428 - protein, 112 aa, Artificial Sequence
  Synthesized sequence with two or more selenocysteine residues substituted for two or more cysteine residues
  VARIANT (1)...(112): Xaa = selenocysteine or cysteine
DVLMTQTPLSLSVTPGQPASISXRSGQNIVHSNGNTYLEWYLQKPGQSPKLLIYKVSNRFFGVPDRISGSGSGTDFTLKISRVEAEDVGVYFXFQGSHVPFTFGQGTKLEIK

SEQ ID NO: 429 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXRASQDISNYLAWFQRKPGKAPKSLIYAASSLHSKVPTQFSGSGSGTDFTLTISSLQPEDFATYYXLQYSTYPITFGGGTKVEIKR

SEQ ID NO: 430 - protein, 115 aa, Artificial Sequence
  Synthesized sequence with two or more selenocysteine residues substituted for two or more cysteine residues
  VARIANT (1)...(115): Xaa = selenocysteine or cysteine
MADVLMTQTPLSLPVSLGDQASISXRSSQSLVHSNGNTYLHWYLQKPGQSPKLLIYKVSNRFSGVPDRFSGSGSGTDFTLKISRVEAEDLGVYFXSQSTHVPFTFGSGTKLELKR

SEQ ID NO: 431 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTITXRASQGIRNYLAWYQQKPGKAPKLLIYAASTLQSGVPSRFSGSGSGTDFTLTISSLQPEDVATYYXQRYNRAPYTFGQGTKVEIK

SEQ ID NO: 432 - protein, 105 aa, Artificial Sequence
  Synthesized sequence with two or more selenocysteine residues substituted for two or more cysteine residues
  VARIANT (1)...(105): Xaa = selenocysteine or cysteine
QIVSTQSPAIMSASPGEKVTMTXSASSSRSYMQWYQQKPGTSPKRWIYDTSKLASGVPARFSGSGSGTSYSLTISSMEAEDAATYYXHQRSSYTFGGGTKLEIKR

SEQ ID NO: 433 - protein, 109 aa, Artificial Sequence
  Synthesized sequence with two or more selenocysteine residues substituted for two or more cysteine residues
  VARIANT (1)...(109): Xaa = selenocysteine or cysteine
SSELTQDPAVSVALGQTVRVTXQGDSLRSYYASWYQQKPGQAPVLVIYGKNNRPSGIPDRFSGSSSGNTASLTITGAQAEDEADYYXSSRDSSGNHWVFGGGTELTVLG

SEQ ID NO: 434 - protein, 111 aa, Artificial Sequence
  Synthesized sequence with two or more selenocysteine residues substituted for two or more cysteine residues
  VARIANT (1)...(111): Xaa = selenocysteine or cysteine
DIQLTQSPASLAVSLGQRATISXKASQSVDYDGDSYLNWYQQIPGQPPKLLIYDASNLVSGIPPRFSGSGSGTDFTLNIHPVEKVDAATYHXQQSTEDPWTFGGGTKLEIK

SEQ ID NO: 435 - protein, 107 aa, Artificial Sequence
  Synthesized sequence with two or more selenocysteine residues substituted for two or more cysteine residues
  VARIANT (1)...(107): Xaa = selenocysteine or cysteine
EIVLTQSPDFQSVTPKEKVTITXRASQSIGSSLHWYQQKPDQSPKLLIKYASQSFSGVPSRFSGSGSGTDFTLTINSLEAEDAAAYYXHQSSSLPFTFGPGTKVDIK

SEQ ID NO: 436 - protein, 112 aa, Artificial Sequence
  Synthesized sequence with two or more selenocysteine residues substituted for two or more cysteine residues
  VARIANT (1)...(112): Xaa = selenocysteine or cysteine
DIVMTQSPLSVPVTPGEPVSISXRSSKSLLHSNGNTYLYWFLQRPGQSPQLLIYRMSNLVSGVPDRFSGSGSGTAFTLRISRVEAEDVGVYYXLQHLEYPFTFGPGTKLELK

SEQ ID NO: 437 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXKASQNVGTNVAWYQQKPGKAPKALIYSASFLYSGVPYRFSGSGSGTDFTLTISSLQPEDFATYYXQQYNIYPLTFGQGTKVEIKR

SEQ ID NO: 438 - protein, 108 aa, Artificial Sequence
  Synthesized sequence with two or more selenocysteine residues substituted for two or more cysteine residues
  VARIANT (1)...(108): Xaa = selenocysteine or cysteine
DILLTQSPVILSVSPGERVSFSXRASQSIGTNIHWYQQRTNGSPRLLIKYASESISGIPSRFSGSGSGTDFTLSINSVESEDIADYYXQQNNNWPTTFGAGTKLELKR

SEQ ID NO: 439 - protein, 113 aa, Artificial Sequence
  Synthesized sequence with two or more selenocysteine residues substituted for two or more cysteine residues
  VARIANT (1)...(113): Xaa = selenocysteine or cysteine
DIQMTQSPSSLSASVGDRVTITXRSTKSLLHSNGITYLYWYQQKPGKAPKLLIYQMSNLASGVPSRFSSSGSGTDFTLTISSLQPEDFATYYXAQNLEIPRTFGQGTKVELKR

SEQ ID NO: 440 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXRASEDLYYNLAWYQRKPGKAPKLLIYDTYRLADGVPSRFSGSGSGTDYTLTISSLQPEDFASYYXQQYYKFPFTFGQGTKVEIKR

SEQ ID NO: 441 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPGTLSLSPGERATLSXRASQSVRGRYLAWYQQKPGQAPRLLIYGASSRATGIPDRFSGSGSGTDFTLTISRLEPEDFAVFYXQQYGSSPRTFGQGTKVEIK

SEQ ID NO: 442 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXRASKTISKYLAWYQQKPGKAPKLLIYSGSTLQSGVPSRFSGSGSGTDFTLTISSLQPEDFATYYXQQHNEYPLTFGQGTKVEIKR

SEQ ID NO: 443 - protein, 108 aa, Artificial Sequence
  Synthesized sequence with two or more selenocysteine residues substituted for two or more cysteine residues
  VARIANT (1)...(108): Xaa = selenocysteine or cysteine
DIVMTQSPATLSVTPGDRVSLSXRASQSISDYLHWYQQKSHESPRLLIKSVSQSISGIPSRFSGSGSGSDFTLSINSVEPEDVGVYYXQNGHSFPLTFGAGTKLELKR

SEQ ID NO: 444 - protein, 111 aa, Artificial Sequence
  Synthesized sequence with two or more selenocysteine residues substituted for two or more cysteine residues
  VARIANT (1)...(111): Xaa = selenocysteine or cysteine
NFMLTQPHSVSESPGKTVTISXTRSSGSIASNYVQWYQQRPGSSPTTVIYEDNQRPSGVPDRFSGSIDSSSNSASLTISGLKTEDEADYYXQSYDGSNRWMFGGGTKLTVL

SEQ ID NO: 445 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPATLSLSPGERATLSXRASQSVYSYLAWYQQKPGQAPRLLIYDASNRATGIPARFSGSGSGTDFTLTISSLEPEDFAVYYXQQRSNWPPFTFGPGTKVDIK

SEQ ID NO: 446 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASIGDRVTITXRASQGIRNYLAWYQQKPGKAPKLLIYAASTLQSGVPSRFSGSGSGTDFTLTISSLQPEDVATYYXQKYNSAPYAFGQGTKVEIK

SEQ ID NO: 447 - protein, 106 aa, Artificial Sequence
  Synthesized sequence with two or more selenocysteine residues substituted for two or more cysteine residues
  VARIANT (1)...(106): Xaa = selenocysteine or cysteine
QIVLSQSPAILSASPGEKVTMTXRASSSVSYIHWFQQKPGSSPKPWIYATSNLASGVPVRFSGSGSGTSYSLTISRVEAEDAATYYXQQWTSNPPTFGGGTKLEIK

SEQ ID NO: 448 - protein, 107 aa, Artificial Sequence
  Synthesized sequence with two or more selenocysteine residues substituted for two or more cysteine residues
  VARIANT (1)...(107): Xaa = selenocysteine or cysteine
DILLTQSPAILSVSPGERVSFSXRASQFVGSSIHWYQQRTNGSPRLLIKYASESMSGIPSRFSGSGSGTDFTLSINTVESEDIADYYXQQSHSWPFTFGSGTNLEVK

SEQ ID NO: 449 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPGTLSLSPGERATLSXRASQSVGSSYLAWYQQKPGQAPRLLIYGAFSRATGIPDRFSGSGSGTDFTLTISRLEPEDFAVYYXQQYGSSPWTFGQGTKVEIK

SEQ ID NO: 450 - protein, 106 aa, Artificial Sequence
  Synthesized sequence with two or more selenocysteine residues substituted for two or more cysteine residues
  VARIANT (1)...(106): Xaa = selenocysteine or cysteine
DIQLTQSPSSLSASVGDRVTITXKASQDVGTSVAWYQQKPGKAPKLLIYWTSTRHTGVPSRFSGSGSGTDFTFTISSLQPEDIATYYXQQYSLYRSFGQGTKVEIK

SEQ ID NO: 451 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTITXRASQDIRYYLNWYQQKPGKAPKLLIYVASSLQSGVPSRFSGSGSGTEFTLTVSSLQPEDFATYYXLQVYSTPRTFGQGTKVEIK

SEQ ID NO: 452 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSLSASVGDRVTITXSASSSVTYMYWYQQKPGKAPKLLIYDTSNLASGVPSRFSGSGSGTDYTFTISSLQPEDIATYYXQQWSSHIFTFGQGTKVEIKR

SEQ ID NO: 453 - protein, 113 aa, Artificial Sequence
  Synthesized sequence with two or more selenocysteine residues substituted for two or more cysteine residues
  VARIANT (1)...(113): Xaa = selenocysteine or cysteine
DIVMTQSPDSLAVSLGERATINXKSSQSLLNSGNQKNYLAWYQQKPGQPPKLLIYGASTRESGVPDRFSGSGSGTDFTLTISSLQAEDVAVYYXQNVHSFPFTFGGGTKLEIK

SEQ ID NO: 454 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQTTSSLSASLGDRVTISXRASQDISNYLNWYQQKPDGTVKLLIYYTSILHSGVPSRFSGSGSGTDYSLTISNLEQEDFATYFXQQGNTLPWTFGXGTKLEIK

SEQ ID NO: 455 - protein, 106 aa, Artificial Sequence
  Synthesized sequence with two or more selenocysteine residues substituted for two or more cysteine residues
  VARIANT (1)...(106): Xaa = selenocysteine or cysteine
SIVMTQTPKFLLVSAGDRVTITXKASQSVTNDVAWYQQKPGQSPKLLIYYASNRYTGVPDRFTGSGYGTDFTFTISTVQAEDLAVYFXQQDYSSPYTFGGGTKLEI

SEQ ID NO: 456 - protein, 113 aa, Artificial Sequence
  Synthesized sequence with two or more selenocysteine residues substituted for two or more cysteine residues
  VARIANT (1)...(113): Xaa = selenocysteine or cysteine
DIQMTQSPSSLSASVGDRVTITXRSSQNIVHSNGNTYLDWYQQTPGKAPKLLIYKVSNRFSGVPSRFSGSGSGTDFTFTISSLQPEDIATYYXFQYSHVPWTFGQGTKLQITR

SEQ ID NO: 457 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPATLSLSPGERATLSXRASQSVSSYLAWYQQKPGQAPRLLIYDASNRATGIPARFSGSGSGTDFTLTISSLEPEDFAVYYXQQRSNWPITFGQGTRLEIKR

SEQ ID NO: 458 - protein, 113 aa, Artificial Sequence; identical to SEQ ID NO: 439
  Synthesized sequence with two or more selenocysteine residues substituted for two or more cysteine residues
  VARIANT (1)...(113): Xaa = selenocysteine or cysteine

SEQ ID NO: 459 - protein, 107 aa, Artificial Sequence
  Synthesized sequence with two or more selenocysteine residues substituted for two or more cysteine residues
  VARIANT (1)...(107): Xaa = selenocysteine or cysteine
EIVLTQSPATLSLSPGERATLSXRASENVYSYLAWYQQKPGQAPRLLIYFAKTLAEGIPARFSGSGSGTDFTLTISSLEPEDFAVYYXQHHSDNPWTFGQGTKVEIK

SEQ ID NO: 460 - protein, 108 aa, Artificial Sequence
  Synthesized sequence with two or more selenocysteine residues substituted for two or more cysteine residues
  VARIANT (1)...(108): Xaa = selenocysteine or cysteine
DIQMTQSPSSLSASVGDRVTITXKASQDVSIGVAWYQQKPGKAPKLLIYSASYRYTGVPSRFSGSGSGTDFTLTISSLQPEDFATYYXQQYYIYPYTFGQGTKVEIKR

SEQ ID NO: 461 - protein, 108 aa, Artificial Sequence
  Synthesized sequence with two or more selenocysteine residues substituted for two or more cysteine residues
  VARIANT (1)...(108): Xaa = selenocysteine or cysteine
EIVLTQSPGTLSLSPGERATLSXRASQSVSSSFLAWYQQKPGQAPRLLIYYASSRATGIPDRFSGSGSGTDFTLTISRLEPEDFAVYYXQQTGRIPPTFGQGTKVEIK

SEQ ID NO: 462 - protein, 108 aa, Artificial Sequence
  Synthesized sequence with two or more selenocysteine residues substituted for two or more cysteine residues
  VARIANT (1)...(108): Xaa = selenocysteine or cysteine
DIQLTQSPSSLSASVGDRVTITXSASQDISNYLNWYQQKPGKAPKVLIYFTSSLHSGVPSRFSGSGSGTDFTLTISSLQPEDFATYYXQQYSTVPWTFGQGTKVEIKR

SEQ ID NO: 463 - protein, 112 aa, Artificial Sequence
  Synthesized sequence with two or more selenocysteine residues substituted for two or more cysteine residues
  VARIANT (1)...(112): Xaa = selenocysteine or cysteine
DIVLTQSPATLSVSPGERATISXRASQRVSSSTYSYMHWYQQKPGQPPKLLIKYASNLESGVPARFSGSGSGTDFTLTISSVEPEDFATYYXQHSWEIPPTFGGGTKLEIKR

SEQ ID NO: 464 - protein, 113 aa, Artificial Sequence
  Synthesized sequence with two or more selenocysteine residues substituted for two or more cysteine residues
  VARIANT (1)...(113): Xaa = selenocysteine or cysteine
DIVMTQSPLSLSVTPGEPASISXRSSQSLLHTNGYNYLDWYVQKPGQSPQLLIYLASNRASGVPDRFSGSGSGTDFTLKISRVETEDVGVYYXMQALQIPRTFGQGTKVEIKR

SEQ ID NO: 465 - protein, 113 aa, Artificial Sequence
  Synthesized sequence with two or more selenocysteine residues substituted for two or more cysteine residues
  VARIANT (1)...(113): Xaa = selenocysteine or cysteine
DIVMTQSPDSLAVSLGERATINXKSSQSLLYSRNQKNYLAWYQQKPGQPPKLLIFWASTRESGVPDRFSGSGFGTDFTLTISSLQAEDVAVYYXQQYFSYPLTFGQGTKVEIK

SEQ ID NO: 466 - protein, 112 aa, Artificial Sequence
  Synthesized sequence with two or more selenocysteine residues substituted for two or more cysteine residues
  VARIANT (1)...(112): Xaa = selenocysteine or cysteine
DVVMTQSPPSLLVTLGQPASISXRSSQSLLHSSGNTYLNWLLQRPGQSPQPLIYLVSKLESGVPDRFSGSGSGTDFTLKISGVEAEDVGVYYXMQFTHYPYTFGQGTKLEIK

SEQ ID NO: 467 - protein, 114 aa, Artificial Sequence
  Synthesized sequence with two or more selenocysteine residues substituted for two or more cysteine residues
  VARIANT (1)...(114): Xaa = selenocysteine or cysteine
ELVMTQSPSSLTVTAGEKVTMSXKSSQSLLNSGNQKNYLTWYQQKPGQPPKLLIYWASTRESGVPDRFTGSGSGTDFTLTISSVQAEDLAVYYXQNDYSYPLTFGAGTKLEIKG

SEQ ID NO: 468 - protein, 108 aa, Artificial Sequence
  Synthesized sequence with two or more selenocysteine residues substituted for two or more cysteine residues
  VARIANT (1)...(108): Xaa = selenocysteine or cysteine
ETTVTQSPSFLSASVGDRVTITXITTTDIDDDMNWFQQEPGKAPKLLISEGNILRPGVPSRFSSSGYGTDFTLTISKLQPEDFATYYXLQSDNLPFTFGQGTKLEIKR

SEQ ID NO: 469 - protein, 107 aa, Artificial Sequence
  Synthesized sequence with two or more selenocysteine residues substituted for two or more cysteine residues
  VARIANT (1)...(107): Xaa = selenocysteine or cysteine
EIVMTQSPATLSVSPGERATLSXRASQSIGTNIHWYQQKPGQAPRLLIYYASESISGIPARFSGSGSGTEFTLTISSLQSEDFAVYYXQQSWSWPTTFGGGTKVEIK

SEQ ID NO: 470 - protein, 107 aa, Artificial Sequence
  Synthesized sequence with two or more selenocysteine residues substituted for two or more cysteine residues
  VARIANT (1)...(107): Xaa = selenocysteine or cysteine
AIQLTQSPSSLSASVGDRVTITXRASQDISSALVWYQQKPGKAPKLLIYDASSLESGVPSRFSGSESGTDFTLTISSLQPEDFATYYXQQFNSYPLTFGGGTKVEIK

SEQ ID NO: 471 - protein, 107 aa, Artificial Sequence
  Synthesized sequence with two or more selenocysteine residues substituted for two or more cysteine residues
  VARIANT (1)...(107): Xaa = selenocysteine or cysteine
DIQMTQSPSSVSASVGDRVTITXRASQDISSWLAWYQHKPGKAPKLLIYAASSLQSGVPSRFSGSGSGTDFTLTISSLQPEDFATYYXQQANSFPYTFGQGTKLEIK

SEQ ID NO: 472 - protein, 468 aa, Artificial Sequence
  Synthesized sequence with two or more selenocysteine residues substituted for two or more cysteine residues
  VARIANT (1)...(468): Xaa = selenocysteine or cysteine
MKHLWFFLLLVAAPRWVLSQVQLQESGPGLVKPSQTLSLTXTVSGGSISSGGYYWSWIRQHPGKGLEWIGIIYYSGSTYYNPSLKSRVTISVDTSKNQFSLKLNSVTAADTAVFYXARVAIVTTIPGGMDVWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 473 - protein, 441 aa, Artificial Sequence
  Synthesized sequence with two or more selenocysteine residues substituted for two or more cysteine residues
  VARIANT (1)...(441): Xaa = selenocysteine or cysteine
QVQLQQWGAGLLKPSETLSLTXAVYGGSFSPYYWSWIRQPPGKGLEWIGEINHSGSTNYNPSLKSRVTISVDTSKNQFSLKLSSVTAADTAVYYXARRAGDFDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 474 - protein, 469 aa, Artificial Sequence
  Synthesized sequence with two or more selenocysteine residues substituted for two or more cysteine residues
  VARIANT (1)...(469): Xaa = selenocysteine or cysteine
MEFGLTWVFLVALLRGVQXQVQLVESGGGVVQPGRSLRLSXAASGFTFSSYGMHWVRQAPGKGLEWVAVMSYDGSKKFYTDSVKGRFTISRDNSKNTLYLQMNSLRAEDTAVYYXARDGGDYVRYHYYGMDVWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 475 - protein, 446 aa, Artificial Sequence
  Synthesized sequence with two or more selenocysteine residues substituted for two or more cysteine residues
  VARIANT (1)...(446): Xaa = selenocysteine or cysteine
QVQLQQSGAEVKKPGASVKVSXKALGYTFTDYEMHWVKQTPVHGLEWIGAIHPGRGGTAYNQKFKGKATLTADKSTSTAYMELSSLTSEDTAVYYXTRITGYFDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 476 - protein, 228 aa, Artificial Sequence
  Synthesized sequence with two or more selenocysteine residues substituted for two or more cysteine residues
  VARIANT (1)...(228): Xaa = selenocysteine or cysteine
EVQLQQSGPELVKTGASVKISXKASGYSFTSYYMHWVKQSHGKSLEWIGEINPYNGGASYNQKIKGRATFTVDTSSRTAYMQFNSLTSEDSAVYYXARSIYGHSVLDYWGQGTSVSVSSAKTTPPSVYPLAPGSAAQTNSMVTLGXLVKGYFPEPVTVTWNSGSLSSGVHTFPAVLQSDLYTLSSSVTVPSSTWPSQTVTXNVAHPASSTKVDKKIVPRDXGXKPXIX

SEQ ID NO: 477 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVESGGGLVQPGGSLRLSXAASGFTFSSFGMHWVRQAPGKGLEWVAYINGGSSTIFYANAVKGRFTISRDNAKNTLYLQMNSLRAEDTAVYYXARYASYGGGAMDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 478 - protein, 465 aa, Artificial Sequence
  Synthesized sequence with two or more selenocysteine residues substituted for two or more cysteine residues
  VARIANT (1)...(465): Xaa = selenocysteine or cysteine
MEFGLSWLFLVAILKGVQXEVQLLESGGGLVQPGGSLRLSXAASGFTFSSYAMSWVRQAPGKGLEWVSTISGSGGSTYYADSVKGRFTISRDNSKNTLYLQMNSLRAEDTAVYYXAKERYNWNYLHYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 479 - protein, 446 aa, Artificial Sequence
  Synthesized sequence with two or more selenocysteine residues substituted for two or more cysteine residues
  VARIANT (1)...(446): Xaa = selenocysteine or cysteine
QVQLVESGGGVVQPGRSLRLSXAASGFTFSSYGMHWVRQAPGKGLEWVAVIWYDGSNQYYADSVKGRFTISRDNSKNTLFLQMHSLRAEDTAVYYXARGLTSGRYGMDVWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 480 - protein, 470 aa, Artificial Sequence
  Synthesized sequence with two or more selenocysteine residues substituted for two or more cysteine residues
  VARIANT (1)...(470): Xaa = selenocysteine or cysteine
MDTLXSTLLLLTIPSWVLSQVTLKESGPALVKPTQTLTLTXTFSGFSLRTSGMGVGWIRQPPGKALEWLAHIWWDDDKSYNPSLKSQLTISKDTSKNQVVLTMTNMDPVDTATYYXARRNYYYDDYFAYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 481 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLVQPGGSLRLSXAASGFTFSRHWMSWVRQAPGKGLEWVSEINPDSRTINYAPSVKGRFTISRDNAKNSLYLQMNSLRAEDTAVYYXARRVRIHYYGAMDSWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 482 - protein, 442 aa, Artificial Sequence
  Synthesized sequence with two or more selenocysteine residues substituted for two or more cysteine residues
  VARIANT (1)...(442): Xaa = selenocysteine or cysteine
EVQLVESGGGLVQPGGSLRLSXAASGFTFSSYGMDWVRQAPGKGLEWVSSIRGSRGSTYYADSVKGRFTISRDNSKNTLYLQMNSLRAEDTAVYYXARLYRYWFDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPG

SEQ ID NO: 483 - protein, 455 aa, Artificial Sequence
  Synthesized sequence with two or more selenocysteine residues substituted for two or more cysteine residues
  VARIANT (1)...(455): Xaa = selenocysteine or cysteine
QLQLQESGPGLVKPSETLSLTXTVSGGSISSSSYWGWIRQPPGKGLEWIGSIYYSGRNYNNPSLKSRVTISVDTSKNQFSLKLSSVTAADTAVYYXARHYYGSGSSYYYYDLDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPDVFLFPPKPKDTLMISRTPEVTXVVVDVSHEDPEVKFNWYVDGVEVHNAKTKPREEQYNSTYRVVSVLTVLHQDWLNGKEYKXKVSNKALPLPEEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 484 - protein, 447 aa, Artificial Sequence
  Synthesized sequence with two or more selenocysteine residues substituted for two or more cysteine residues
  VARIANT (1)...(447): Xaa = selenocysteine or cysteine
EVQLQQSGPELVKPGASVKISXKASGYSFIGYFMNWVMQSHGRSLEWIGRINPYNGYTFYNQKFKGKATLTVDKSSSTAHMELRSLASEDSAVYYXARHFRYDGVFYYAMDYWGQGTSVTVSSAKTTPPSVYPLAPGSAAQTNSMVTLGXLVKGYFPEPVTVTWNSGSLSSGVHTFPAVLQSDLYTLSSSVTVPSSTWPSETVTXNVAHPASSTKVDKKIVPRDXGXKPXIXTVPEVSSVFIFPPKPKDVLTITLTPKVTXVVVDISKDDPEVQFSWFVDDVEVHTAQTQPREEQFNSTFRSVSELPIMHQDWLNGKEFKXRVNSAAFPAPIEKTISKTKGRPKAPQVYTIPPPKEQMAKDKVSLTXMITDFFPEDITVEWQWNGQPAENYKNTQPIMDTDGSYFVYSKLNVQKSNWEAGNTFTXSVLHEGLHNHHTEKSLSHSPGK

SEQ ID NO: 485 - protein, 452 aa, Artificial Sequence
  Synthesized sequence with two or more selenocysteine residues substituted for two or more cysteine residues
  VARIANT (1)...(452): Xaa = selenocysteine or cysteine
EVHLVESGGGLVQPGGALRLSXAASGFTFSNYDMHWVRQATGKGLEWVSANGTAGDTYYPGSVKGRFTISRENAKNSLYLQMNSLRAGDTAVYYXARDVDIVATITDYFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 486 - protein, 453 aa, Artificial Sequence
  Synthesized sequence with two or more selenocysteine residues substituted for two or more cysteine residues
  VARIANT (1)...(453): Xaa = selenocysteine or cysteine
QVQLVQSGAEVKKPGASVKVSXKASGYTFTSYDINWVRQATGQGLEWMGWMNPNSGNTGYAQKFQGRVTMTRNTSISTAYMELSSLRSEDTAVYYXARGGYSSSWYYWYFDLWGRGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 487 - protein, 222 aa, Artificial Sequence
  Synthesized sequence with two or more selenocysteine residues substituted for two or more cysteine residues
  VARIANT (1)...(222): Xaa = selenocysteine or cysteine
EVQLQQSGPELMKPGASVKISXKATGYTFSTSWIEWIKQRPGHGLEWIGEVLPGSGKSNHNANFKGRATFTADTASNTAYMQLSSLTSEDSAVYYXAREGSNNNALAYWGQGTLVTVSAASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSX

SEQ ID NO: 488 - protein, 229 aa, Artificial Sequence
  Synthesized sequence with two or more selenocysteine residues substituted for two or more cysteine residues
  VARIANT (1)...(229): Xaa = selenocysteine or cysteine
QVQLVESGGGLVQPGGSLRLSXAASGFTFNSYWINWVRQAPGKGLEWVSGIAYDSSNTLYADSVKGRFTISRDNSKNTLYLQMNSLRAEDTAVYYXARGLGAFHWDMQPDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTH

SEQ ID NO: 489 - protein, 471 aa, Artificial Sequence
  Synthesized sequence with two or more selenocysteine residues substituted for two or more cysteine residues
  VARIANT (1)...(471): Xaa = selenocysteine or cysteine
MDWTWRILFLVAAATGAHSQVQLVQSGAEVKKPGASVKVSXKASGYTFTGYYMHWVRQAPGQGLEWMGWINPDSGGTNYAQKFQGRVTMTRDTSISTAYMELNRLRSDDTAVYYXARDQPLGYXTNGVXSYFDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 490 - protein, 222 aa, Artificial Sequence
  Synthesized sequence with two or more selenocysteine residues substituted for two or more cysteine residues
  VARIANT (1)...(222): Xaa = selenocysteine or cysteine
EVQLLESGGGLVQPGGSLRLSXAASGFTFPWYRVHWVRQAPGKGLEWVSSIRSSGGFPYYNYKVKGRFTISRDNSKNTLYLQMNSLRAEDTAVYYXARFYDSFFDIWGQGTMVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPP

SEQ ID NO: 491 - protein, 444 aa, Artificial Sequence
  Synthesized sequence with two or more selenocysteine residues substituted for two or more cysteine residues
  VARIANT (1)...(444): Xaa = selenocysteine or cysteine
QVELVQSGAEVKKPGSSVKVSXKASGGTFSAIHWVRQAPGQGLEWMGGIIPIFGMADYAQKFQGRVTITADESTSTAYMELSSLRSEDTAVYYXARTDYGFRALDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 492 - protein, 452 aa, Artificial Sequence
  Synthesized sequence with two or more selenocysteine residues substituted for two or more cysteine residues
  VARIANT (1)...(452): Xaa = selenocysteine or cysteine
EVQLVESGAEVKKPGASVKVSXKASGYSFSGYTMNWVRQAPGQRLEWMGLINPYNGGTSYNQNFKGRVTLTVDTSASTAYLELNSLRSEDTGVYYXAREDYDGYLYFAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 493 - protein, 223 aa, Artificial Sequence
  Synthesized sequence with two or more selenocysteine residues substituted for two or more cysteine residues
  VARIANT (1)...(223): Xaa = selenocysteine or cysteine
EVQLQQPGAELVQPGTSVRLSXKASGYIFTTYWIHWVKQRPGQGLEWIGEINPNNGRINYNEKFKTKATLTVDKSSSTAYMQLSSLTSEDSAVYYXTRVGVMITTFPYWGQGTLVTVSAASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVHHHHHH

SEQ ID NO: 494 - protein, 444 aa, Artificial Sequence
  Synthesized sequence with two or more selenocysteine residues substituted for two or more cysteine residues
  VARIANT (1)...(444): Xaa = selenocysteine or cysteine
QVQLLESGAVLARPGTSVKISXKASGFNIKDYYMHWVKQRPGQGLEWIGGNDPANGHSMYDPKFQGRVTITADTSTSTVFMELSSLRSEDTAVYYXARDSGYAMDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 495 - protein, 443 aa, Artificial Sequence
  Synthesized sequence with two or more selenocysteine residues substituted for two or more cysteine residues
  VARIANT (1)...(443): Xaa = selenocysteine or cysteine
EVQLVQSGAEVEKPGASVKISXKASGSSFTGYNMNWVRQNIGKSLEWIGAIDPYYGGTSYNQKFKGRATLTVDKSTSTAYMHLKSLRSEDTAVYYXVSGMEYWGQGTSVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXAVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 496 - protein, 455 aa, Artificial Sequence
  Synthesized sequence with two or more selenocysteine residues substituted for two or more cysteine residues
  VARIANT (1)...(455): Xaa = selenocysteine or cysteine
QVQLVQSGAEVKKPGSSVRVSXKASGFYIKDTYMHWVIQAPGQGLEWMGTIDPANGNTKYVPKFQGRVTITADTSTSTAYMRLSSLRSEDTAVYYXARSIYDDYHYDDYYAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 497 - protein, 448 aa, Artificial Sequence
  Synthesized sequence with two or more selenocysteine residues substituted for two or more cysteine residues
  VARIANT (1)...(448): Xaa = selenocysteine or cysteine
QIQLVQSGPELKKPGETVKISXKASGYTFTNYGMNWVKQAPGKGLKWMGWIHTYTGKPTHADDFKGRFAFSLETSASTAYLQISNLKNEDMATYFXARGSLSTAMDYWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 498 - protein, 450 aa, Artificial Sequence
  Synthesized sequence with two or more selenocysteine residues substituted for two or more cysteine residues
  VARIANT (1)...(450): Xaa = selenocysteine or cysteine
EVQLVESGGGLVQPGGSLRLSXAASGFNIKDTYIHWVRQAPGKGLEWIGRIDPANDNIKYDPKFQGRFTISADNAKNSAYLQMNSLRAEDTAVYYXARSEENWYDFFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPEALGAPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 499 - protein, 453 aa, Artificial Sequence
  Synthesized sequence with two or more selenocysteine residues substituted for two or more cysteine residues
  VARIANT (1)...(453): Xaa = selenocysteine or cysteine
QVQLQQSGPGLVKPSQTLSLTXAISGDSVSGNSATWNWIRQSPSRGLEWLGRTYYRSKWNHDYAESVKSRITINPDTSKNQFSLQLNSVTPEDTAVYYXARGDSSSWYAFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 500 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVQSGAEVKKPGASVKVSXKASGYTFTSYYMHWVRQAPGQGLEWMGIINPSGGSTSYAQKFQGRVTMTRDTSTSTVYMELSSLRSEDTAVYYXARGVGAHDAFDIWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 501 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGVVQPGRSLRLSXSASGFDFTTYWMSWVRQAPGKGLEWIGEIHPDSSTINYAPSLKDRFTISRDNAKNTLFLQMDSLRPEDTGVYFXASLYFGFPWFAYWGQGTPVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 502 - protein, 456 aa, Artificial Sequence
  Synthesized sequence with two or more selenocysteine residues substituted for two or more cysteine residues
  VARIANT (1)...(456): Xaa = selenocysteine or cysteine
QVQLVESGGGVVQPGRSLRLSXTASGFTFKNYAMHWVRQAPAKGLEWVATISYDGRNIQYADSVKGRFTFSRDNSQDTLYLQLNSLRPEDTAVYYXARPVRSRWLQLGLEDAFHIWGQGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 503 - protein, 443 aa, Artificial Sequence
  Synthesized sequence with two or more selenocysteine residues substituted for two or more cysteine residues
  VARIANT (1)...(443): Xaa = selenocysteine or cysteine
QVQLVQSGAEVKKPGSSVKVSXKASGYTFLIYPISWVRQAPGQGLEWMGNFHPYLGVTNYVEKFKGRVTITADKSTSTAYMELSSLRSEDTAVYYXARGGTGSFDYWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 504 - protein, 440 aa, Artificial Sequence
  Synthesized sequence with two or more selenocysteine residues substituted for two or more cysteine residues
  VARIANT (1)...(440): Xaa = selenocysteine or cysteine
QVQLVQSGAEVKKPGSSVKVSXKASGYAFTSFLIEWVRQAPGQGLEWMGTSNPRTGGRKYKEKFRGRVTITADKSTSTAYMELSSLRSEDTAVYYXAREFFDYWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEAAGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 505 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLVKPGGSLRLSXAASGFPFSKLGMVWVRQAPGKGLEWVSTISSGGGYTYYPDSVKGRFTISRDNAKNSLYLQMNSLRAEDTAVYYXAREGISFQGGTYTYVMDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEAAGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 506 - protein, 451 aa, Artificial Sequence
  Synthesized sequence with two or more selenocysteine residues substituted for two or more cysteine residues
  VARIANT (1)...(451): Xaa = selenocysteine or cysteine
QLQVQESGPGLVKPSETLSLTXTVSGGSISNSYFSWGWIRQPPGKGLEWIGSFYYGEKTYYNPSLKSRATISIDTSKSQFSLKLSSVTAADTAVYYXPRGPTMIRGVIDSWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 507 - protein, 456 aa, Artificial Sequence
  Synthesized sequence with two or more selenocysteine residues substituted for two or more cysteine residues
  VARIANT (1)...(456): Xaa = selenocysteine or cysteine
EVQLVQSGAEVKKPGASVKVSXKASGYMFTSYGISWVRQAPGQGLEWMGWVSTYNGDTNYAQKFQGRVTVTTDTSTSTAYMELRSLRSEDTAVYYXARVLGYYDSIDGYYYGMDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 508 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGAEVKKPGASVKVSXKASGYSFTDYNMVWVRQAPGQGLEWMGYIDPYNGGTGYNQKFEGRVTMTTDTSTSTAYMELRSLRSDDTAVYYXARTRDRYDVWYFDVWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEAAGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 509 - protein, 443 aa, Artificial Sequence
  Synthesized sequence with two or more selenocysteine residues substituted for two or more cysteine residues
  VARIANT (1)...(443): Xaa = selenocysteine or cysteine
QVQLVQSGAEVKKPGASVKVSXKASGYTFTDYWMHWVRQAPGQGLEWMGLIDTSDVYTIYNQKFKGRVTMTRDTSTSTVYMELSSLRSEDTAVYYXARYGPLAMDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEAAGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 510 - protein, 471 aa, Artificial Sequence
  Synthesized sequence with two or more selenocysteine residues substituted for two or more cysteine residues
  VARIANT (1)...(471): Xaa = selenocysteine or cysteine
MEFGLSWVFLVALLRGVQXQVQLVESGGGVVQPGRSLRLSXTASGFTFSMFGVHWVRQAPGKGLEWVAAVSYDGSNKYYAESVKGRFTISRDNSKNILFLQMDSLRLEDTAVYYXARGRPKVVIPAPLAHWGQGTLVTFSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 511 - protein, 448 aa, Artificial Sequence
  Synthesized sequence with two or more selenocysteine residues substituted for two or more cysteine residues
  VARIANT (1)...(448): Xaa = selenocysteine or cysteine
EVQLVESGGGLVQPGGSLRLSXAASGFTISSNYMIWVRQAPGKGLEWVSDLYYYAGDTYYADSVKGRFTMSRDISKNTVYLQMNSLRAEDTAVYYXARWADDHPPWIDLWGRGTLVTVSSASTKGPSVFPLAPSSKSTSGGTAALGXLVKDYFPEPVTVSWNSGALTSGVHTFPAVLQSSGLYSLSSWTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRWSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 512 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLVKPGGSLKLSXAASGYTFTSYVMHWVRQAPGKGLEWIGYINPYNDGTKYNEKFQGRVTISSDKSISTAYMELSSLRSEDTAMYYXARGTYYYGTRVFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPDVFLFPPKPKDTLMISRTPEVTXVVVDVSHEDPEVQFNWYVDGVEVHNAKTKPREEQFNSTFRVVSVLTVVHQDWLNGKEYKXKVSNKALPAPEEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 513 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLVQPGGSLRLSXAASGFTFSRHWMHWLRQVPGKGPVWVSRINGAGTSITYADSVRGRFTISRDNANNTLFLQMNSLRADDTALYFXARANSVWFRGLFDYWGQGTPVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 514 - protein, 468 aa, Artificial Sequence
  Synthesized sequence with two or more selenocysteine residues substituted for two or more cysteine residues
  VARIANT (1)...(468): Xaa = selenocysteine or cysteine
MGVLILLWLFTAFPGILSDVQLQESGPGLVKPSQSLSLTXTVTGYSITSDYAWNWIRQFPGNKLEWMGYISYSGSTSYNPSLKSRVSITRDTSKNQFFLQLNSVTTEDTATYYXARFYYRYADYFDYWGQGTTLTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 515 - protein, 442 aa, Artificial Sequence
  Synthesized sequence with two or more selenocysteine residues substituted for two or more cysteine residues
  VARIANT (1)...(442): Xaa = selenocysteine or cysteine
QVQLQQWGAGLLKPSETLSLTXAIYGGSFREYYWSWIRQPPGKGLEWIGEIFHSGSTNYNPSLKSRVTISVDTSKNQFSLKLSSVTAADTAVYYXAREELDDFDIWGQGTMVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 516 - protein, 449 aa, Artificial Sequence
  Synthesized sequence with two or more selenocysteine residues substituted for two or more cysteine residues
  VARIANT (1)...(449): Xaa = selenocysteine or cysteine
QVTLKESGPGLLKPTQTLTLTXTLSGFSLSTSGMGVGWFRQPPGKGLEWLAHIWWDDDKSYNPSLKSRLTISKDTSKNQVVLTITNVDPVDTATYYXARRQLGTRGTDAMDYWGQGTTVTVSSASTKGPSVFPLAPXSRSTSESTAALGXLVKDYFPEPVTVSWNSGALTSGVHTFPAVLQSSGLYSLSSVVTVTSSNFGTQTYTXNVDHKPSNTKVDKTVERKXXVEXPPXPAPPVAGPSVFLFPPKPKDTLMISRTPEVTXVVVDVSQEDPEVQFNWYVDGVEVHNAKTKPREEQFNSTFRVVSVLTVLHQDWLNGKEYKXKVSNKGLPSSIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 517 - protein, 438 aa, Artificial Sequence
  Synthesized sequence with two or more selenocysteine residues substituted for two or more cysteine residues
  VARIANT (1)...(438): Xaa = selenocysteine or cysteine
EVQLVQSGAEVKKPGASVKVSXKASGYTFTDYYIHWVRQAPGQGLEWMGWIHSNSGATTYAQKFQARVTMSRDTSSSTAYMELSRLESDDTAMYFXSREDYWGQGTLVTVSSASTKGPSVFPLAPXSRSTSESTAALGXLVKDYFPEPVTVSWNSGALTSGVHTFPAVLQSSGLYSLSSVVTVTSSNFGTQTYTXNVDHKPSNTKVDKTVERKXXVEXPPXPAPPVAGPSVFLFPPKPKDTLMISRTPEVTXVVVDVSQEDPEVQFNWYVDGVEVHNAKTKPREEQFNSTFRVVSVLTVLHQDWLNGKEYKXKVSNKGLPSSIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 518 - protein, 461 aa, Artificial Sequence
  Synthesized sequence with two or more selenocysteine residues substituted for two or more cysteine residues
  VARIANT (1)...(461): Xaa = selenocysteine or cysteine
MGWSYIILFLVATATDGHSQVQLQQPGTELVKPGASVKLSXKASGYTFTSYWIHWVKQRPGQGLEWIGEINPSSGRTNYNEKFKNKVTVTVDKSSTTAYMQLSNLTSEDSAVYYXASRGYWGQGTTLTVSSAKTTAPSVYPLAPVXGNTTGSSVTLGXLVKGYFPEPVTLTWNSGSLSSGVHTFPAVLQSDLYTLSSSVTVTSSTWPSQSITXNVAHPASSTKVDKKIEPRGPTIKPXPPXKXPAPNLLGGPSVFIFPPKIKDVLMISLSPIVTXVVVDVSEDDPDVQISWFVNNVEVHTAQTQTHREDYNSTLRVVSALPIQHQDWMSGKEFKXKVNNKDLPAPIERTISKPKGSVRAPQVYVLPPPEEEMTKKQVTLTXMVTDFMPEDIYVEWTNNGKTELNYKNTEPVLDSDGSYFMYSKLRVEKKNWVERNSYSXSVVHEGLHNHHTTKSFSRTPGK

SEQ ID NO: 519 - protein, 475 aa, Artificial Sequence
  Synthesized sequence with two or more selenocysteine residues substituted for two or more cysteine residues
  VARIANT (1)...(475): Xaa = selenocysteine or cysteine
MELGLXWLFLVAILEGVQXGVQLVESGGGLVQPGGSLRLSXAASGFTISRNDMHWVRQATGKGLEWVSAIGTGGDTYYPGSVKGRFTISRENAKNSLYLQMNSLRAGDTAVYYXARGHMTTFGGFIVIGNGMDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 520 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVESGGGLVQPGGSLRLSXVASGFTFSNYWMNWVRQAPGKGLEWVAEIRLKSNNYATHYAESVKGRFTISRDDSKNTVYLQMNSLRAEDTAVYYXTRNGNYVDYAMDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFEGGPSVFLFPPKPKDTLMISRTPEVTXVWDVSQEDPEVQFNWYVDGVEVHNAKTKPREEQFNSTYRWSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 521 - protein, 442 aa, Artificial Sequence
  Synthesized sequence with two or more selenocysteine residues substituted for two or more cysteine residues
  VARIANT (1)...(442): Xaa = selenocysteine or cysteine
QVQLVQSGSELKKPGASVKLSXKASGFTFTTYGINWVRQAPGQGLEWIGWIYPRDGSTNFNENFKDRATITVDTSASTAYMELSSLRSEDTAVYFXARLTGGTFLDYWGQGTTVTVSSASTKGPSVFPLAPXSRSTSESTAALGXLVKDYFPEPVTVSWNSGALTSGVHTFPAVLQSSGLYSLSSWTVPSSSLGTKTYTXNVDHKPSNTKVDKRVESKYGPPXPPXPAPEFLGGPSVFLFPPKPKDTLMISRTPEVTXWVDVSQEDPEVQFNWYVDGVEVHNAKTKPREEQFNSTYRWSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 522 - protein, 450 aa, Artificial Sequence
  Synthesized sequence with two or more selenocysteine residues substituted for two or more cysteine residues
  VARIANT (1)...(450): Xaa = selenocysteine or cysteine
QVQLVQSGAEVKKPGASVKVSXKASGYAFSSSWMNWVRQAPGQGLEWIGRIYPGDGDTKYNGKFKGKATLTADKSTSTAYMELSSLRSEDTAVYYXARSTMIATGAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDQLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVLHEALHNHYTQKSLSLSPGK

SEQ ID NO: 523 - protein, 469 aa, Artificial Sequence
  Synthesized sequence with two or more selenocysteine residues substituted for two or more cysteine residues
  VARIANT (1)...(469): Xaa = selenocysteine or cysteine
MDWTWSILFLVAAATGAHSQVQLVQSGAEVKKPGASVKVSXKASGYTFTSYGINWVRQAPGQGLEWMGWISVYSGNTNYAQKVQGRVTMTADTSTSTAYMDLRSLRSDDTAVYYXAREGSSSSGDYYYGMDVWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 524 - protein, 432 aa, Artificial Sequence
  Synthesized sequence with two or more selenocysteine residues substituted for two or more cysteine residues
  VARIANT (1)...(432): Xaa = selenocysteine or cysteine
EVQLVESGGGLVKPGGSLRLSXAASGFTFDDSVMHWVRQAPGKGLEWVSLVGWDGFFTYYADSVKGRFTISRDNAKNSLYLQMNSLRAEDTAVYYXARQGDYMGNNWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 525 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGLVQPGGSLRLSXAASGFSLTNNNVNWVRQAPGKGLEWVGGVWAGGATDYNSALKSRFTISRDNSKNTAYLQMNSLRAEDTAVYYXARDGGYSSSTLYAMDAWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 526 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLVQPGGSLRLSXAASGFTFSSTAIHWVRQAPGKGLEWVARISPANGNTNYADSVKGRFTISADTSKNTAYLQMNSLRAEDTAVYYXARWIGSRELYIMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 527 - protein, 437 aa, Artificial Sequence
  Synthesized sequence with two or more selenocysteine residues substituted for two or more cysteine residues
  VARIANT (1)...(437): Xaa = selenocysteine or cysteine
QVQLVQSGAEVKKPGASVKVSXKASGYTFTNYDIIWVRQAPGQGLEWMGYINPYNDGTKYNEKFKGRVTMTRDTSTSTVYMELSSLRSEDTAVYYXARLLKYRRFRYYAIDYWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPSSIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 528 - protein, 467 aa, Artificial Sequence
  Synthesized sequence with two or more selenocysteine residues substituted for two or more cysteine residues
  VARIANT (1)...(467): Xaa = selenocysteine or cysteine
MGWSXIILFLVATATGVHSQVQLVQSGAEVVKPGASVKISXKASGYTFTAYYMHWVKQSPVQSLEWIGLVNPYNGFSSYNQKFQGKASLTVDRSSSTAYMELHSLTSEDSAVYYXAREFYGYRYFDVWGQGTAVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 529 - protein, 450 aa, Artificial Sequence
  Synthesized sequence with two or more selenocysteine residues substituted for two or more cysteine residues
  VARIANT (1)...(450): Xaa = selenocysteine or cysteine
QVQLQQSGAELVRSGASIKLSXTASGFNIKHYYMHWVKQRPEQGLEWIGWINPENVDTEYAPKFQGKATMTADTSSNTAYLQLSSLTSEDTAVYYXNHYRYAGGGALDYWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 530 - protein, 469 aa, Artificial Sequence
  Synthesized sequence with two or more selenocysteine residues substituted for two or more cysteine residues
  VARIANT (1)...(469): Xaa = selenocysteine or cysteine
MDXTWRILFLVAAATGTHAEVQLVQSGAEVKKPGASVKVSXKVSGYTFSGNWIEWVRQAPGKGLEWIGEILPGSGNTNYNEKFKGKATMTADTSTDTAYMELSSLRSEDTAVYYXARGGHYYGSSWDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 531 - protein, 467 aa, Artificial Sequence
  Synthesized sequence with two or more selenocysteine residues substituted for two or more cysteine residues
  VARIANT (1)...(467): Xaa = selenocysteine or cysteine
MEWIWIFLLILSGTRGVQSQVQLVQSGAEVKKPGASVKVSXKASGYTFTAYVISWVRQAPGQGLEWMGEIYPGSGSSYYNEKFKGRVTNTRDTSTSTVYMELSSLRSEDTAVYYXARSGDGSRFVYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYASTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLQSDGSFFLYSKLTVDKSRWQQGNVFSXSVMHEALHNHYTQKSLSLSPGK

SEQ ID NO: 532 - protein, 452 aa, Artificial Sequence
  Synthesized sequence with two or more selenocysteine residues substituted for two or more cysteine residues
  VARIANT (1)...(452): Xaa = selenocysteine or cysteine
EVQLLESGGGLVQPGGSLRLSXAASGFTFNNYDMTWVRQAPGKGLEWVAVISYDGSDKDYADSVKGRFTISRDNSKNTLYLQMNSLRAEDTAVYYXARVYYYGFSGPSMDVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 533 - protein, 464 aa, Artificial Sequence
  Synthesized sequence with two or more selenocysteine residues substituted for two or more cysteine residues
  VARIANT (1)...(464): Xaa = selenocysteine or cysteine
MGWSRIFLFLLSITAGVHXQVQLQQSGPELVKPGASVKISXKASGYAFSISWMNWVKQRPGQGLEWIGRIFPGDGDTNYNGKFKDKATLTADKSSSTAYMYLSSLTSVDSAVYFXTRWDFTAVAPTFDVWGAGTTVTVSSAKTTPPSVYPLAPGSAAQTNSMVTLGXLVKGYFPEPVTVTWNSGSLSSGVHTFPAVLQSDLYTLSSSVTVPSSTWPSETVTXNVAHPASSTKVDKKIVPRDXGXKPXIXTVPEVSSVFIFPPKPKDVLTITLTPKVTXVVVDISKDDPEVQFSWFVDDVEVHTAQTQPREEQFNSTFRSVSELPIMHQDWLNGKEFKXRVNSAAFPAPIEKTISKTKGRPKAPQVYTIPPPKEQMAKDKVSLTXMITDFFPEDITVEWQWNGQPAENYKNTQPIMDTDGSYFVYSKLNVQKSNWEAGNTFTXSVLHEGLHNHHTEKSLSHSPGK

SEQ ID NO: 534 - protein, 453 aa, Artificial Sequence
  Synthesized sequence with two or more selenocysteine residues substituted for two or more cysteine residues
  VARIANT (1)...(453): Xaa = selenocysteine or cysteine
EVQLLQSGGGLTHPGGSLRLSXAASGFPFHKYTMTWVRQPPGKGLEWVSSVSGVNGKTYYSPSVRGRAIVSRDDSNSMLFLEIKNMTAGDTALYFXAKGPGGHLHYYYGLDVWGHGTSVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 535 - protein, 228 aa, Artificial Sequence
  Synthesized sequence with two or more selenocysteine residues substituted for two or more cysteine residues
  VARIANT (1)...(228): Xaa = selenocysteine or cysteine
EVQLVESGGGLVQPGRSLRLSXSASGFTFGDYAMSWFRLAPGKGLEWVGLIKSRAIDGTPQYAASVKGRFTISRDDSNSIAYLQMNSLTTEDTAIYYXARDFYDFWNEFSHRTFDFWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPK

SEQ ID NO: 536 - protein, 454 aa, Artificial Sequence
  Synthesized sequence with two or more selenocysteine residues substituted for two or more cysteine residues
  VARIANT (1)...(454): Xaa = selenocysteine or cysteine
QVQLQQSGPGLVKPSQTLSLTXAISGDSVSSNSAAWGWIRQSPGRGLEWLGRIYYRSKWYNSYAVSVKSRITINPDTSKNQFSLQLNSVTPEDTAVYYXARYDWVPKIGVFDSWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 537 - protein, 448 aa, Artificial Sequence
  Synthesized sequence with two or more selenocysteine residues substituted for two or more cysteine residues
  VARIANT (1)...(448): Xaa = selenocysteine or cysteine
EVRLLESGGGLVQPGGSLRLSXAASGFTFRPRAMAWVRQAPGKGLEWVSSISAQGASAYYADSVKGRFTISRDNSKNTLYLQMNSLRAEDTAVYYXARDLSVSGFGPWGRGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 538 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGLVQPGGSLRLSXAASGYTFTNFGMNWVRQAPGKGLEWVAWINTNTGEPRYAEEFKGRFTISRDNAKNSLYLQMNSLRAEDTAVYYXARDWDGAYFFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 539 - protein, 443 aa, Artificial Sequence
  Synthesized sequence with two or more selenocysteine residues substituted for two or more cysteine residues
  VARIANT (1)...(443): Xaa = selenocysteine or cysteine
QVKLQESGAELARPGASVKLSXKASGYTFTNYWMQWVKQRPGQGLDWIGAIYPGDGNTRYTHKFKGKATLTADKSSSTAYMQLSSLASEDSGVYYXARGEGNYAWFAYWGQGTTVTVSSAKTTPPSVYPLAPGSAAQTNSMVTLGXLVKGYFPEPVTVTWNSGSLSSGVHTFPAVLQSDLYTLSSSVTVPSSTWPSETVTXNVAHPASSTKVDKKIVPRDXGXKPXIXTVPEVSSVFIFPPKPKDVLTITLTPKVTXVVVDISKDDPEVQFSWFVDDVEVHTAQTQPREEQFNSTFRSVSELPIMHQDWLNGKEFKXRVNSAAFPAPIEKTISKTKGRPKAPQVYTIPPPKEQMAKDKVSLTXMITDFFPEDITVEWQWNGQPAENYKNTQPIMDTDGSYFVYSKLNVQKSNWEAGNTFTXSVLHEGLHNHHTEKSLSHSPGK

SEQ ID NO: 540 - protein, 446 aa, Artificial Sequence
  Synthesized sequence with two or more selenocysteine residues substituted for two or more cysteine residues
  VARIANT (1)...(446): Xaa = selenocysteine or cysteine
QVQLQQSGGELAKPGASVKVSXKASGYTFSSFWMHWVRQAPGQGLEWIGYINPRSGYTEYNEIFRDKATMTTDTSTSTAYMELSSLRSEDTAVYYXASFLGRGAMDYWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVEPKSSDKTHTXPPXPAPPVAGPSVFLFPPKPKDTLMISRTPEVTXWVDVSHEDPEVQFNWYVDGVEVHNAKTKPREEQAQSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 541 - protein, 444 aa, Artificial Sequence
  Synthesized sequence with two or more selenocysteine residues substituted for two or more cysteine residues
  VARIANT (1)...(444): Xaa = selenocysteine or cysteine
QVQLVQSGAEVKKPGASVKVSXKVSGYTLSDLSIHWVRQAPGKGLEWMGGFDPQDGETIYAQKFQGRVTMTEDTSTDTAYMELSSLKSEDTAVYYXATGSSSSWFDPWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 542 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVQSGAEVKKSGESLKISXKGSGYSFTSYWIGWVRQMPGKGLEWMGIFYPGDSSTRYSPSFQGQVTISADKSVNTAYLQWSSLKASDTAMYYXARRRNWGNAFDIWGQGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 543 - protein, 457 aa, Artificial Sequence
  Synthesized sequence with two or more selenocysteine residues substituted for two or more cysteine residues
  VARIANT (1)...(457): Xaa = selenocysteine or cysteine
EVQLLESGGGVVQPGRSLRLSXAASGFTFSSYGMHWVRQAPGKGLEWVAVISYDGSNKYYADSVKGRFTISRDNSKNTLYLQMNSLRAEDTAVYYXAKDMGWGSGWRPYYYYGMDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 544 - protein, 453 aa, Artificial Sequence
  Synthesized sequence with two or more selenocysteine residues substituted for two or more cysteine residues
  VARIANT (1)...(453): Xaa = selenocysteine or cysteine
QVQLVESGGGVVQPGRSLRLSXAASGFAFSSYGMHWVRQAPGKGLEWVAVIWFDGTKKYYTDSVKGRFTISRDNSKNTLYLQMNTLRAEDTAVYYXARDRGIGARRGPYYMDVWGKGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 545 - protein, 453 aa, Artificial Sequence
  Synthesized sequence with two or more selenocysteine residues substituted for two or more cysteine residues
  VARIANT (1)...(453): Xaa = selenocysteine or cysteine
EVQLVESGGGLVQPGRSLRLSXAASGFTFDDYAMHWVRQAPGKGLEWVSGINWSSGGIGYADSVKGRFTISRDNAKNSLYLQMNSLRAEDTALYYXARDIGGFGEFYWNFGLWGRGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 546 - protein, 444 aa, Artificial Sequence
  Synthesized sequence with two or more selenocysteine residues substituted for two or more cysteine residues
  VARIANT (1)...(444): Xaa = selenocysteine or cysteine
EVQLVESGGGLVQPGGSLRLSXAASGFTFSSYGMSWVRQAPGKGLEWVATITSGGSYTYYVDSVKGRFTISRDNAKNTLYLQMNSLRAEDTAVYYXVRIGEDALDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 547 - protein, 219 aa, Artificial Sequence
  Synthesized sequence with two or more selenocysteine residues substituted for two or more cysteine residues
  VARIANT (1)...(219): Xaa = selenocysteine or cysteine
QVQLQESGPGLVRPSQTLSLTXTVSGFTFTDFYMNWVRQPPGRGLEWIGFIRDKAKGYTTEYNPSVKGRVTMLVDTSKNQFSLRLSSVTAADTAVYYXAREGHTAAPFDYWGQGSLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKV

SEQ ID NO: 548 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVESGGGLVQPGGSLRLSXAASGFTFNNYAMNWVRQAPGKGLDWVSTISGSGGTTNYADSVKGRFIISRDSSKHTLYLQMNSLRAEDTAVYYXAKDSNWGNFDLWGRGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 549 - protein, 449 aa, Artificial Sequence
  Synthesized sequence with two or more selenocysteine residues substituted for two or more cysteine residues
  VARIANT (1)...(449): Xaa = selenocysteine or cysteine
QVQLQQSGPELEKPGASVKISXKASGYSFTGYTMNWVKQSHGKSLEWIGLITPYNGASSYNQKFRGKATLTVDKSSSTAYMDLLSLTSEDSAVYFXARGGYDGRGFDYWGSGTPVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 550 - protein, 442 aa, Artificial Sequence
  Synthesized sequence with two or more selenocysteine residues substituted for two or more cysteine residues
  VARIANT (1)...(442): Xaa = selenocysteine or cysteine
QVQLQESGPGLVKPSETLSLTXTVSGFSLLSYGVHWVRQPPGKGLEWLGVIWTGGTTNYNSALMSRFTISKDDSKNTVYLKMNSLKTEDTAIYYXARYYYGMDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 551 - protein, 450 aa, Artificial Sequence
  Synthesized sequence with two or more selenocysteine residues substituted for two or more cysteine residues
  VARIANT (1)...(450): Xaa = selenocysteine or cysteine
QVELVQSGAEVKKPGESLKISXKGSGYSFTSYWIGWVRQAPGKGLEWMGIIDPGDSRTRYSPSFQGQVTISADKSISTAYLQWSSLKASDTAMYYXARGQLYGGTYMDGWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 552 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVQSGAEVKKPGESLKISXKGSGYIFTNYWIAWVRQMPGKGLESMGIIYPGDSDIRYSPSFQGQVTISADKSITTAYLQWSSLKASDTAMYYXARHDIEGFDYWGRGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPEFEGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPASIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 553 - protein, 448 aa, Artificial Sequence
  Synthesized sequence with two or more selenocysteine residues substituted for two or more cysteine residues
  VARIANT (1)...(448): Xaa = selenocysteine or cysteine
EVQLVESGGGLVQPGGSLRLSXAASGFTFISYAMSWVRQAPGKGLEWVASISSGGNTYYPDSVKGRFTISRDNAKNSLYLQMNSLRAEDTAVYYXARLDGYYFGFAYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPEALGAPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 554 - protein, 451 aa, Artificial Sequence
  Synthesized sequence with two or more selenocysteine residues substituted for two or more cysteine residues
  VARIANT (1)...(451): Xaa = selenocysteine or cysteine
EVQLLESGGGLVQPGGSLRLSXAASGFTFSSYAMSWVRQAPGKGLEWVSAISGSGTSTYYADSVKGRFTISRDNSKNTLYLQMNSLRAEDTAVYYXARVRYNWNHGDWFDPWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 555 - protein, 443 aa, Artificial Sequence
  Synthesized sequence with two or more selenocysteine residues substituted for two or more cysteine residues
  VARIANT (1)...(443): Xaa = selenocysteine or cysteine
QVQLQESGPGLVKPSQTLSLTXTVSGGSISSGEYYWNWIRQHPGKGLEWIGYIYYSGSTYYNPSLKSRVTISVDTSKNQFSLKLSSVTAADTAVYYXARESVAGFDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPG

SEQ ID NO: 556 - protein, 448 aa, Artificial Sequence
  Synthesized sequence with two or more selenocysteine residues substituted for two or more cysteine residues
  VARIANT (1)...(448): Xaa = selenocysteine or cysteine
EVQLVESGGGLVQPGGSLRLSXAASGFTFSDSWIHWVRQAPGKGLEWVAWISPYGGSTYYADSVKGRFTISADTSKNTAYLQMNSLRAEDTAVYYXARRHWPGGFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYASTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 557 - protein, 441 aa, Artificial Sequence
  Synthesized sequence with two or more selenocysteine residues substituted for two or more cysteine residues
  VARIANT (1)...(441): Xaa = selenocysteine or cysteine
EVQLVESGGGLVQPGGSLRLSXAASGFTFSNYWMSWVRQAPGKGLEWVATIKQDGSQKNYVDSVKGRFTISRDNAKNSLYLRLNSLRAEDTAVYYXATELFDLWGRGSLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 558 - protein, 450 aa, Artificial Sequence
  Synthesized sequence with two or more selenocysteine residues substituted for two or more cysteine residues
  VARIANT (1)...(450): Xaa = selenocysteine or cysteine
EVQLLESGGGLVQPGGSLRLSXAASGFTFSSYIMMWVRQAPGKGLEWVSSIYPSGGITFYADTVKGRFTISRDNSKNTLYLQMNSLRAEDTAVYYXARIKLGTVTTVDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 559 - protein, 469 aa, Artificial Sequence
  Synthesized sequence with two or more selenocysteine residues substituted for two or more cysteine residues
  VARIANT (1)...(469): Xaa = selenocysteine or cysteine
MEFGLSWLFLVAILKGVQXEVQLLESGGGLVQPGGSLRLSXAASGFTFSNYGMSWVRQAPGKGLEWVASIRSGGGRTYYSDNVKGRFTISRDNSKNTLYLQMNSLRAEDTAVYYXVRYDHYSGSSDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPEALGAPSVFLFPPKPKDTLMISRTPEVTXVVVDVSHEDPEVIXFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 560 - protein, 450 aa, Artificial Sequence
  Synthesized sequence with two or more selenocysteine residues substituted for two or more cysteine residues
  VARIANT (1)...(450): Xaa = selenocysteine or cysteine
EVQLQQSGPELEKPGASVKLSXKASGYSFTGYNMNWVKQSHGKSLEWIGHIDPYYGDTSYNQKFRGKATLTVDKSSSTAYMQLKSLTSEDSAVYYXVKGGYYGHWYFDVWGAGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 561 - protein, 456 aa, Artificial Sequence
  Synthesized sequence with two or more selenocysteine residues substituted for two or more cysteine residues
  VARIANT (1)...(456): Xaa = selenocysteine or cysteine
QVQLQQSGAELVKPGASVKLSXKASGYTFRSYDINWVRQRPEQGLEWIGWIFPGDGSTKYNEKFKGKATLTTDKSSSTAYMQLSRLTSEDSAVYFXARWTVVGPGYFDVWGAGTTVTVSSAKTTPPSVYPLAPGXGDTTGSSVTLGXLVKGYFPESVTVTWNSGSLSSSVHTFPALLQSGLYTMSSSVTVPSSTWPSQTVTXSVAHPASSTTVDKKLEPSGPISTINPXPPXKEXHKXPAPNLEGGPSVFIFPPNIKDVLMISLTPKVTXVVVDVSEDDPDVQISWFVNNVEVHTAQTQTHREDYNSTIRVVSTLPIQHQDWMSGKEFKXKVNNKDLPSPIERTISKIKGLVRAPQVYILPPPAEQLSRKDVSLTXLVVGFNPGDISVEWTSNGHTEENYKDTAPVLDSDGSYFIYSKLNMKTSKWEKTDSFSXNVRHEGLKNYYLKKTISRSPGK

SEQ ID NO: 562 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVQSGAEVKKPGASVKVSXKASGYTFTSYVIHWVRQRPGQGLAWMGYINPYNDGTKYNERFKGKVTITSDRSTSTVYMELSSLRSEDTAVYLXGREGIRYYGLLGDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 563 - protein, 231 aa, Artificial Sequence
  Synthesized sequence with two or more selenocysteine residues substituted for two or more cysteine residues
  VARIANT (1)...(231): Xaa = selenocysteine or cysteine
EVQLVESGGGLVQPGGSLRLSXAASGYTFTNYGMNWVRQAPGKGLEWVGWINTYTGEPTYAADFKRRFTFSLDTSKSTAYLQMNSLRAEDTAVYYXAKYPHYYGSSHWYFDVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHT

SEQ ID NO: 564 - protein, 449 aa, Artificial Sequence; identical to SEQ ID NO: 542
  Synthesized sequence with two or more selenocysteine residues substituted for two or more cysteine residues
  VARIANT (1)...(449): Xaa = selenocysteine or cysteine

SEQ ID NO: 565 - protein, 445 aa, Artificial Sequence
  Synthesized sequence with two or more selenocysteine residues substituted for two or more cysteine residues
  VARIANT (1)...(445): Xaa = selenocysteine or cysteine
QVQLVQSGAEVKKPGASVKVSXKASGYTFTSSYINWVRQAPGQGLEWMGTINPVSGSTSYAQKFQGRVTMTRDTSISTAYMELSRLRSDDTAVYYXARGGWFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPEAAGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 566 - protein, 455 aa, Artificial Sequence
  Synthesized sequence with two or more selenocysteine residues substituted for two or more cysteine residues
  VARIANT (1)...(455): Xaa = selenocysteine or cysteine
EVQLVESGGGLVQPGGSLRLSXAASGFTFSDYNMAWVRQAPGKGLEWVATITYEGRNTYYRDSVKGRFTISRDNAKNSLYLQMNSLRAEDTAVYYXASPPQYYEGSIYRLWFAHWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 567 - protein, 444 aa, Artificial Sequence
  Synthesized sequence with two or more selenocysteine residues substituted for two or more cysteine residues
  VARIANT (1)...(444): Xaa = selenocysteine or cysteine
EVQLVESGGGLVKPGGSLRLSXAASGFTFSSYDMSWVRQAPGKGLEWVSTISSGGSYTYYLDSIKGRFTISRDNAKNSLYLQMNSLRAEDTAVYYXARQGLDYWGRGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 568 - protein, 448 aa, Artificial Sequence
  Synthesized sequence with two or more selenocysteine residues substituted for two or more cysteine residues
  VARIANT (1)...(448): Xaa = selenocysteine or cysteine
QLQLQESGPGLLKPSETLSLTXTVSGGSISSPGYYGGWIRQPPGKGLEWIGSIYKSGSTYHNPSLKSRVTISVDTSKNQFSLKLSSVTAADTAVYYXTRPVVRYFGWFDPWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFEGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 569 - protein, 444 aa, Artificial Sequence
  Synthesized sequence with two or more selenocysteine residues substituted for two or more cysteine residues
  VARIANT (1)...(444): Xaa = selenocysteine or cysteine
QVQLVQSGAEVKKPGASVKVSXKVSGFPIKDTFQHWVRQAPGKGLEWMGWSDPEIGDTEYASKFQGRVTMTEDTSTDTAYMELSSLRSEDTAVYYXATGDTTYKFDFWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 570 - protein, 444 aa, Artificial Sequence
  Synthesized sequence with two or more selenocysteine residues substituted for two or more cysteine residues
  VARIANT (1)...(444): Xaa = selenocysteine or cysteine
QVQLVQSGAEVKKPGASVKVSXKASGYTFTSYYMHWVRQAPGQGLEWMGEISPFGGRTNYNEKFKSRVTMTRDTSTSTVYMELSSLRSEDTAVYYXARERPLYASDLWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPSSIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 571 - protein, 450 aa, Artificial Sequence
  Synthesized sequence with two or more selenocysteine residues substituted for two or more cysteine residues
  VARIANT (1)...(450): Xaa = selenocysteine or cysteine
QVQLVESGGGVVQPGRSLRLSXAASGFTFSSYGMHWVRQAPGKGLEWVAVIWYDGSNEYYADSVKGRFTISRDNSKNTLYLQMNSLRAEDTAVYYXARDRGYTSSWYPDAFDIWGQGTMVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 572 - protein, 446 aa, Artificial Sequence
  Synthesized sequence with two or more selenocysteine residues substituted for two or more cysteine residues
  VARIANT (1)...(446): Xaa = selenocysteine or cysteine
QIQLQQSGPEVVKPGASVKISXKASGYTFTDYYITWVKQKPGQGLEWIGWIYPGSGNTKYNEKFKGKATLTVDTSSSTAFMQLSSLTSEDTAVYFXANYGNYWFAYWGQGTQVTVSAASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 573 - protein, 445 aa, Artificial Sequence
  Synthesized sequence with two or more selenocysteine residues substituted for two or more cysteine residues
  VARIANT (1)...(445): Xaa = selenocysteine or cysteine
QVQLVESGGGVVQPGRSLRLSXAASGFTFSSYGMHWVRQAPGKGLEWVAFIRYDGSNKYYADSVKGRFTISRDNSKNTLYLQMNSLRAEDTAVYYXKTHGSHDNWGQGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 574 - protein, 442 aa, Artificial Sequence
  Synthesized sequence with two or more selenocysteine residues substituted for two or more cysteine residues
  VARIANT (1)...(442): Xaa = selenocysteine or cysteine
QVQLVQSGAEVKKPGASVKVSXKASGYTFTRYGISWVRQAPGQGLEWMGWISTYSGNTNYAQKLQGRVTMTTDTSTSTAYMELRSLRSDDTAVYYXARRQLYFDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 575 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGAEVKKPGASVKVSXKASGYTFTNHYMHWVRQAPGQGLEWMGIINPISGSTSNAQKFQGRVTMTRDTSTSTVYMELSSLRSEDTAVYYXARDIVDAFDFWGQGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 576 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVQSGAEVKKPGSSVKVSXKASGYTFTDNYMIWVRQAPGQGLEWMGDINPYNGGTTFNQKFKGRVTITADKSTSTAYMELSSLRSEDTAVYYXARESPYFSNLYVMDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 577 - protein, 443 aa, Artificial Sequence
  Synthesized sequence with two or more selenocysteine residues substituted for two or more cysteine residues
  VARIANT (1)...(443): Xaa = selenocysteine or cysteine
EVQLVESGGGLVQPGGSLRLSXAASGFTFSSYMMSWVRQAPGKGLEWVATISGGGANTYYPDSVKGRFTISRDNAKNSLYLQMNSLRAEDTAVYYXARQLYYFDYWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 578 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVQSGAEVKKPGETVKISXKASDYTFTYYGMNWVKQAPGQGLKWMGWIDTTTGEPTYAQKFQGRIAFSLETSASTAYLQIKSLKSEDTATYFXARRGPYNWYFDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 579 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVQSGAEVKKPGSSVKVSXKASGGTFSSYGISWVRQAPGQGLEWMGGIIPIFGTANYAQKFQGRVTITADESTSTAYMELSSLRSEDTAVYYXARYDGIYGELDFWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 580 - protein, 448 aa, Artificial Sequence
  Synthesized sequence with two or more selenocysteine residues substituted for two or more cysteine residues
  VARIANT (1)...(448): Xaa = selenocysteine or cysteine
EVKLEESGGGLVQPGGSMKLSXAASGFTFSDAWMDWVRQSPEKGLEWVAEIRSKASNHATYYAESVKGRFTISRDDSKSSVYLQMNSLRAEDTGIYYXTRWRRFFDSWGQGTTLTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 581 - protein, 451 aa, Artificial Sequence
  Synthesized sequence with two or more selenocysteine residues substituted for two or more cysteine residues
  VARIANT (1)...(451): Xaa = selenocysteine or cysteine
QVQLVQSGAEVKKPGASVKVSXKASGYTFTEFGMNWVRQAPGQGLEWMGWINTKTGEATYVEEFKGRVTFTTDTSTSTAYMELRSLRSDDTAVYYXARWDFAYYVEAMDYWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPEAAGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALGAPIEKTISKAKGQPREPQVXTLPPSRDELTKNQVSLSXAVKGFYPSDIAVEWESNGQPENNYKTTPPVLDSDGSFFLVSKLTVDKSRWQQGNVFSXSVMHEALHNHYTQKSLSLSPGK

SEQ ID NO: 582 - protein, 460 aa, Artificial Sequence
  Synthesized sequence with two or more selenocysteine residues substituted for two or more cysteine residues
  VARIANT (1)...(460): Xaa = selenocysteine or cysteine
EVQLVQSGAEVKKPGSSVKVSXKASGGTFSSYAISWVRQAPGQGLEWMGGIIPIFGTANYAQKFQGRVTITADKSTSTAYMELSSLRSEDTAVYYXARAPLRFLEWSTQDHYYYYYMDVWGKGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 583 - protein, 450 aa, Artificial Sequence
  Synthesized sequence with two or more selenocysteine residues substituted for two or more cysteine residues
  VARIANT (1)...(450): Xaa = selenocysteine or cysteine
EVQLVESGGGLVQPGGSLRLSXAASGFSLSNYYVTWVRQAPGKGLEWVGIIYGSDETAYATSAIGRFTISRDNSKNTLYLQMNSLRAEDTAVYYXARDDSSDWDAKFNLWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYASTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 584 - protein, 449 aa, Artificial Sequence
  Synthesized sequence with two or more selenocysteine residues substituted for two or more cysteine residues
  VARIANT (1)...(449): Xaa = selenocysteine or cysteine
QVQLQQSGAEVKKPGASVKVSXEASGYTFPSYVLHWVKQAPGQGLEWIGYINPYNDGTQYNEKFKGKATLTRDTSINTAYMELSRLRSDDTAVYYXARGFGGSYGFAYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 585 - protein, 445 aa, Artificial Sequence
  Synthesized sequence with two or more selenocysteine residues substituted for two or more cysteine residues
  VARIANT (1)...(445): Xaa = selenocysteine or cysteine
QVQLVQSGAEVKKPGASVKVSXKASGYTFTDYEMHWVRQAPGQGLEWMGALDPKTGDTAYSQKFKGRVTLTADKSTSTAYMELSSLTSEDTAVYYXTRFYSYTYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 586 - protein, 450 aa, Artificial Sequence
  Synthesized sequence with two or more selenocysteine residues substituted for two or more cysteine residues
  VARIANT (1)...(450): Xaa = selenocysteine or cysteine
QVQLVQPGAEVVKPGASVKLSXKTSGYTFTSNWMHWVKQAPGQGLEWIGEIDPSDSYTNYNQNFQGKAKLTVDKSTSTAYMEVSSLRSDDTAVYYXARGSNPYYYAMDYWGQGTSVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 587 - protein, 452 aa, Artificial Sequence
  Synthesized sequence with two or more selenocysteine residues substituted for two or more cysteine residues
  VARIANT (1)...(452): Xaa = selenocysteine or cysteine
QVQLQESGPGLVKPSQTLSLTXTVSGGSISSGDYFWSWIRQLPGKGLEWIGHIHNSGTTYYNPSLKSRVTISVDTSKKQFSLRLSSVTAADTAVYYXARDRGGDYYYGMDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 588 - protein, 448 aa, Artificial Sequence
  Synthesized sequence with two or more selenocysteine residues substituted for two or more cysteine residues
  VARIANT (1)...(448): Xaa = selenocysteine or cysteine
EVQLVESGGGLVKPGGSLRLSXAASGFTFSNYAMSWVRQTPEKRLEWVATISRSGSYSYFPDSVQGRFTISRDNAKNSLYLQMNSLRAEDTAVYYXARLGGYDEGDAMDSWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 589 - protein, 439 aa, Artificial Sequence
  Synthesized sequence with two or more selenocysteine residues substituted for two or more cysteine residues
  VARIANT (1)...(439): Xaa = selenocysteine or cysteine
EVQLVESGGGLVQPGGSLRLSXAASGFTFSSYGMSWVRQAPGKGLELVASINSNGGSTYYPDSVKGRFTISRDNAKNSLYLQMNSLRAEDTAVYYXASGDYWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 590 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVQSGAEVKKPGASVKVSXKVSGYTFTSYDINWVRQAPGKGLEWMGWIYPGDGSIKYNEKFKGRVTMTVDKSTDTAYMELSSLRSEDTAVYYXARRGEYGNYEGAMDYWGQGTLVTVSSASTKGPSVFPLAPXSRSTSESTAALGXLVKDYFPEPVTVSWNSGALTSGVHTFPAVLQSSGLYSLSSVVTVTSSNFGTQTYTXNVDHKPSNTKVDKTVERKXXVEXPPXPAPPVAGPSVFLFPPKPKDTLMISRTPEVTXVVVDVSHEDPEVQFNWYVDGMEVHNAKTKPREEQFNSTFRVVSVLTVVHQDWLNGKEYKXAVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 591 - protein, 455 aa, Artificial Sequence
  Synthesized sequence with two or more selenocysteine residues substituted for two or more cysteine residues
  VARIANT (1)...(455): Xaa = selenocysteine or cysteine
EVQLVESGGGLVQPGGSLRLSXAASGFTFSNYLMNWVRQAPGKGLEWLANIQEDGIEKYYVDSVKGRFTISRDNAKNSLYLQMNSLRAEDTAVYYXAREPSHYDILTGYDYYYGMDVWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 592 - protein, 444 aa, Artificial Sequence
  Synthesized sequence with two or more selenocysteine residues substituted for two or more cysteine residues
  VARIANT (1)...(444): Xaa = selenocysteine or cysteine
EVQLVESGGGLVQPGGSLRLSXAASGYSFTGYYIHWVRQAPGKGLEWVARVIPNAGGTSYNQKFKGRFTLSVDNSKNTAYLQMNSLRAEDTAVYYXAREGIYWWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 593 - protein, 446 aa, Artificial Sequence
  Synthesized sequence with two or more selenocysteine residues substituted for two or more cysteine residues
  VARIANT (1)...(446): Xaa = selenocysteine or cysteine
QVQLVQSGAEVKKPGSSVKVSXKASGYTFTSYRMHWVRQAPGQGLEWIGYINPSTGYTEYNQKFKDKATITADESTNTAYMELSSLRSEDTAVYYXARGGGVFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 594 - protein, 447 aa, Artificial Sequence
  Synthesized sequence with two or more selenocysteine residues substituted for two or more cysteine residues
  VARIANT (1)...(447): Xaa = selenocysteine or cysteine
QVQLQQSGPGLVKPSQTLSLTXTVSGWSISGGWLWNWIRQPPGKGLQWIGWISWDGTNNWKPSLKDRVTISVDTSKNQFSLKLSSVTAADTAVWWXARWGRVFFDWWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 595 - protein, 452 aa, Artificial Sequence
  Synthesized sequence with two or more selenocysteine residues substituted for two or more cysteine residues
  VARIANT (1)...(452): Xaa = selenocysteine or cysteine
EVQLLESGGGLVQPGGSLRLSXAVSGFTFNSFAMSWVRQAPGKGLEWVSAISGSGGGTYYADSVKGRFTISRDNSKNTLYLQMNSLRAEDTAVYFXAKDKILWFGEPVFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 596 - protein, 450 aa, Artificial Sequence
  Synthesized sequence with two or more selenocysteine residues substituted for two or more cysteine residues
  VARIANT (1)...(450): Xaa = selenocysteine or cysteine
EVQLVESGGGVVQPGRSLRLSXAASGFTFSSYGMHWVRQAPGKGLEWVAIIWYDGSNKYYADSVKGRFTISRDNSKNTLYLQMNSLRAEDTAVYYXARLWFGDLDAFDIWGQGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 597 - protein, 444 aa, Artificial Sequence
  Synthesized sequence with two or more selenocysteine residues substituted for two or more cysteine residues
  VARIANT (1)...(444): Xaa = selenocysteine or cysteine
QVQLVQSGAEVKKPGASVKISXKASGYSFTAYYIHWVKQAPGQGLEWIGYISSYNGATNYNQKFKGRVTFTTDTSTSTAYMELRSLRSDDTAVYYXARDYDYDVGMDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPG

SEQ ID NO: 598 - protein, 450 aa, Artificial Sequence
  Synthesized sequence with two or more selenocysteine residues substituted for two or more cysteine residues
  VARIANT (1)...(450): Xaa = selenocysteine or cysteine
QVQLQESGPGLVKPSQTLSLTXTVSGGSISTSGMGVGWIRQHPGKGLEWIGHIWWDDDKRYNPALKSRVTISVDTSKNQFSLKLSSVTAADTAVYYXARMELWSYYFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 599 - protein, 446 aa, Artificial Sequence
  Synthesized sequence with two or more selenocysteine residues substituted for two or more cysteine residues
  VARIANT (1)...(446): Xaa = selenocysteine or cysteine
QVQLQESGPGLVKPSQTLSLTXTVSGYSISSDFAWNWIRQPPGKGLEWMGYISYSGNTRYQPSLKSRITISRDTSKNQFFLKLNSVTAADTATYYXVTAGRGFPYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 600 - protein, 450 aa, Artificial Sequence
  Synthesized sequence with two or more selenocysteine residues substituted for two or more cysteine residues
  VARIANT (1)...(450): Xaa = selenocysteine or cysteine
QVQLKESGPGLVAPSQSLSITXTVSGFSLTDYGVRWIRQPPGKGLEWLGVIWGGGSTYYNSALKSRLSISKDNSKSQVFLKMNSLQTDDTAMYYXAKEKRRGYYYAMDYWGQGTSVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKAEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 601 - protein, 452 aa, Artificial Sequence
  Synthesized sequence with two or more selenocysteine residues substituted for two or more cysteine residues
  VARIANT (1)...(452): Xaa = selenocysteine or cysteine
QVQLVQSGAEVKKPGSSVKVSXKASGFTFATYNMHWVRQAPGQGLEWMGYIYPGDGNANYNQQFKGRVTITADKSTSTAYMELSSLRSEDTAVYYXARGDFDYDGGYYFDSWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 602 - protein, 443 aa, Artificial Sequence
  Synthesized sequence with two or more selenocysteine residues substituted for two or more cysteine residues
  VARIANT (1)...(443): Xaa = selenocysteine or cysteine
EVQLLQSGPELEKPGASVMISXKASGSSFTGYNMNWVRQNIGKSLEWIGAIDPYYGGTSYNQKFKGRATLTVDKSSSTAYMHLKSLTSEDSAVYYXVSGMEYWGQGTSVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 603 - protein, 445 aa, Artificial Sequence
  Synthesized sequence with two or more selenocysteine residues substituted for two or more cysteine residues
  VARIANT (1)...(445): Xaa = selenocysteine or cysteine
EVQLLESGGGLVQPGGSLRLSXAASGFTFSSYAMSWVRQAPGKGLEWVSTISSGGSYTSYPDSVKGRFTISRDNSKNTLYLQMNSLRAEDTAVYYXAKQDYAMNYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPEAAGAPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 604 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVQSGGGVERPGGSLRLSXAASGFTFDDYAMSWVRQAPGKGLEWVSGINWQGGSTGYADSVKGRVTISRDNAKNSLYLQMNSLRAEDTAVYYXAKILGAGRGWYFDYWGKGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 605 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLVQPGGSLRLSXAASGFTLSGDWIHWVRQAPGKGLEWVGEISAAGGYTDYADSVKGRFTISADTSKNTAYLQMNSLRAEDTAVYYXARESRVSFEAAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 606 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLEQPGGSLRLSXAGSGFTFRDYAMTWVRQAPGKGLEWVSSISGSGGNTYYADSVKGRFTISRDNSKNTLYLQMNSLRAEDTAVYYXAKDRLSITIRPRYYGLDVWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 607 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLVQPGGSLRLSXAASGFTFSRYWMSWVRQAPGKGLEWVANIKQDGSEKYYVDSVKGRFTISRDNAKNSLYLQMNSLRAEDTAVYYXAREGGWFGELAFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPEFEGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPASIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 608 - protein, 446 aa, Artificial Sequence
  Synthesized sequence with two or more selenocysteine residues substituted for two or more cysteine residues
  VARIANT (1)...(446): Xaa = selenocysteine or cysteine
QVQLVQSGAEVKKPGASVKVSXKASGYTFTSYDINWVRQATGQGLEWMGWMNPNSGNTGYAQKFQGRVTMTRNTSISTAYMELSSLRSEDTAVYYXARDPYYYYYGMDVWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 609 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVQSGAEVKKPGASVKVSXKASGYIFSNYWIQWVRQAPGQGLEWMGEILPGSGSTEYTENFKDRVTMTRDTSTSTVYMELSSLRSEDTAVYYXARYFFGSSPNWYFDVWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 610 - protein, 454 aa, Artificial Sequence
  Synthesized sequence with two or more selenocysteine residues substituted for two or more cysteine residues
  VARIANT (1)...(454): Xaa = selenocysteine or cysteine
QMQLVESGGGVVQPGRSLRLSXTASGFTFSNNGMHWVRQAPGKGLEWVAVIWFDGMNKFYVDSVKGRFTISRDNSKNTLYLEMNSLRAEDTAIYYXAREGDGSGIYYYYGMDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 611 - protein, 450 aa, Artificial Sequence
  Synthesized sequence with two or more selenocysteine residues substituted for two or more cysteine residues
  VARIANT (1)...(450): Xaa = selenocysteine or cysteine
EVQLVQSGAEVKKPGASVKVSXKASGYTFTSHGISWVRQAPGQGLDWMGWISPYSGNTNYAQKLQGRVTMTTDTSTSTAYMELSSLRSEDTAVYYXARVGSGPYYYMDVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPEAAGGPSVFLFPPKPKDQLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVLHEALHNHYTQKSLSLSPGK

SEQ ID NO: 612 - protein, 447 aa, Artificial Sequence
  Synthesized sequence with two or more selenocysteine residues substituted for two or more cysteine residues
  VARIANT (1)...(447): Xaa = selenocysteine or cysteine
EVQLLESGGGLVQPGGSLRLSXAASGFTFSSYAMSWVRQAPGKGLEWVSAINSQGKSTYYADSVKGRFTISRDNSKNTLYLQMNSLRAEDTAVYYXARWGDEGFDIWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 613 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGLVQPGGSLRLSXAASGFDFSRYWMSWVRQAPGKGLEWIGEINPDSSTINYAPSLKDKFIISRDNAKNSLYLQMNSLRAEDTAVYYXARPDGNYWYFDVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 614 - protein, 446 aa, Artificial Sequence
  Synthesized sequence with two or more selenocysteine residues substituted for two or more cysteine residues
  VARIANT (1)...(446): Xaa = selenocysteine or cysteine
QVQLVQSGAEVKKPGASVKVSXKASGYTFTSYDISWVRQAPGQGLEWMGVIWTDGGTNYAQKLQGRVTMTTDTSTSTAYMELRSLRSDDTAVYYXARDQRLYFDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 615 - protein, 440 aa, Artificial Sequence
  Synthesized sequence with two or more selenocysteine residues substituted for two or more cysteine residues
  VARIANT (1)...(440): Xaa = selenocysteine or cysteine
QVQLVQSGAEVKKPGASVKVSXKASGYTFTDYYMHWVRQAPGQGLEWMGRVNPNRRGTTYNQKFEGRVTMTTDTSTSTAYMELRSLRSDDTAVYYXARANWLDYWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGMEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPG

SEQ ID NO: 616 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVESGGGLVQPGGSLRLSXAASGFTFSYYDIQWVRQAPGKGLEWVSSISPSGQSTYYRREVKGRFTISRDNSKNTLYLQMNSLRAEDTAVYYXARRTGREYGGGWYFDYWGQGTLVTVSSASTKGPSVFPLAPXSRSTSESTAALGXLVKDYFPEPVTVSWNSGALTSGVHTFPAVLQSSGLYSLSSVVTVPSSSLGTQTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQYNSTYRVVSVLTVLHQDWLNGKEYKXKVSNKGLPSSIEKTISKAKGQPREPQVYTLPPSQKEMTKNQVSLTXLVKGFYPSDIAVEWESNGQPENNYKTTPPVLDSDGSFFLYSKLTVDKSRWQEGNVFSXSVMHEALHNRYTQKSLSLSP

SEQ ID NO: 617 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGLVQPGGSLRLSXAASGFTFSSYWMSWVRQAPGKGLEWVAEIRLKSDNYATHYAESVKGRFTISRDDSKNSLYLQMNSLRAEDTAVYYXTGYYADAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 618 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVESGGGLVQPGGSLRLSXAASGFTFSSYNMNWVRQAPGKGLEWVSYISSSSSTIYYADSVKGRFTISRDNAKNSLSLQMNSLRDEDTAVYYXARAYYYGMDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 619 - protein, 452 aa, Artificial Sequence
  Synthesized sequence with two or more selenocysteine residues substituted for two or more cysteine residues
  VARIANT (1)...(452): Xaa = selenocysteine or cysteine
EVQLVESGGGLVQPGGSLRLSXAASGFTFSSFGMHWVRQAPGKGLEWVAYISSDSSAIYYADTVKGRFTISRDNAKNSLYLQMNSLRDEDTAVYYXGRGRENIYYGSRLDYWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELVGGPSVFLLPPKPKDTLMISRTPEVTXVVVDVSHEDPEVKFNWYVDGVEVHNAKTKPPEEQYNSTLRVVSVLTVLHQDWLNGKEYKXKVSNKALPAPIEKTISKAKGQPREPQVYTLPPSREEMTKNQVSLTXLVKGFYPSDIAVEWESNGQPENNYKTTPLVLDSDGSFFLYSKLTVDKSRWQQGNVFSXSVMHEALHNHYTQKSLSLSPGK

SEQ ID NO: 620 - protein, 452 aa, Artificial Sequence
  Synthesized sequence with two or more selenocysteine residues substituted for two or more cysteine residues
  VARIANT (1)...(452): Xaa = selenocysteine or cysteine
QVQLVQSGAEVKKPGSSVKVSXKASGGTFSYYWIEWVRQAPGQGLEWMGEILPGSGTTNPNEKFKGRVTITADESTSTAYMELSSLRSEDTAVYYXARADYYGSDYVKFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 621 - protein, 452 aa, Artificial Sequence
  Synthesized sequence with two or more selenocysteine residues substituted for two or more cysteine residues
  VARIANT (1)...(452): Xaa = selenocysteine or cysteine
QVQLVESGGGVVQPGRSLRLSXAASGFTFSSYGMHWVRQAPGKGLEWVSFLWYDGTNKNYVESVKGRFTISRDNSKNMLYLEMNSLRAEDTAVYYXARDHDFRSGYEGWFDPWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 622 - protein, 443 aa, Artificial Sequence
  Synthesized sequence with two or more selenocysteine residues substituted for two or more cysteine residues
  VARIANT (1)...(443): Xaa = selenocysteine or cysteine
QVQLKESGPDLVAPSQSLSITXTVSGFSLSKFGVNWVRQPPGKGLEWLGVIWGDGSTSYNSGLISRLSISKENSKSQVFLKLNSLQADDTATYYXVKPGGDYWGHGTSVTVSSASTKGPSVFPLAPSSKSTSGGTAALGXLVKDYFPEPVTVSWNSGALTSGVHTFPAVLQSSGPYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTMPPVLDSDGSFFLYSKLTVDKSRWQQGNVFSXSVMHEALHNHYTQKSLSLSPGK

SEQ ID NO: 623 - protein, 467 aa, Artificial Sequence
  Synthesized sequence with two or more selenocysteine residues substituted for two or more cysteine residues
  VARIANT (1)...(467): Xaa = selenocysteine or cysteine
MDFGFSLVFLALILKGVQXEVQLVQSGAEVKKPGASVKVSXKASGYRFTNYWIHWVRQAPGQGLEWIGGINPGNNYATYRRKFQGRVTMTADTSTSTVYMELSSLRSEDTAVYYXTREGYGNYGAWFAYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 624 - protein, 441 aa, Artificial Sequence
  Synthesized sequence with two or more selenocysteine residues substituted for two or more cysteine residues
  VARIANT (1)...(441): Xaa = selenocysteine or cysteine
EVQLVESGGGLVQPGGSLRLSXAVSGIDLSGYYMNWVRQAPGKGLEWVGVIGINGATYYASWAKGRFTISRDNSKTTVYLQMNSLRAEDTAVYFXARGDIWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDARVEPKSXDKTHTXPPXPAPELLGGPSVFLFPPKPKDTLMISRTPEVTXVVVDVSHEDPEVKFNWYVDGVEVHNAKTKPREEQYASTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 625 - protein, 456 aa, Artificial Sequence
  Synthesized sequence with two or more selenocysteine residues substituted for two or more cysteine residues
  VARIANT (1)...(456): Xaa = selenocysteine or cysteine
QVQLVESGGGVVQPGRSLRLSXAASGFTFSSFGMHWVRQAPGKGLEWVAVISFDGSIKYSVDSVKGRFTISRDNSKNTLFLQMNSLRAEDTAVYYXARDRLNYYDSSGYYHYKYYGMAVWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 626 - protein, 277 aa, Artificial Sequence
  Synthesized sequence with two or more selenocysteine residues substituted for two or more cysteine residues
  VARIANT (1)...(277): Xaa = selenocysteine or cysteine
EVQLVESGGGLVQPGGSLRLSXATSGYTFTEYTMHWMRQAPGKGLEWVAGINPKNGGTSHNQRFMDRFTISVDKSTSTAYMQMNSLRAEDTAVYYXARWRGLNYGFDVRYFDVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGRMKQLEDKVEELLSKNYHLENEVARLKKLVGER

SEQ ID NO: 627 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVESGGGVVQPGRSLRLSXAASGFTFSSYDMSWVRQAPGKGLEWVAKVSSGGGSTYYLDTVQGRFTISRDNSKNTLYLQMNSLRAEDTAVYYXARHLHGSFASWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 628 - protein, 446 aa, Artificial Sequence
  Synthesized sequence with two or more selenocysteine residues substituted for two or more cysteine residues
  VARIANT (1)...(446): Xaa = selenocysteine or cysteine
EVQLVESGGGLVQPGGSLRLSXAASGFFITNNYWGWVRQAPGKGLEWVGYISYSGSTSYNPSLKSRFTISRDTSKNTFYLQMNSLRAEDTAVYYXARTGSSGYFDFWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 629 - protein, 453 aa, Artificial Sequence
  Synthesized sequence with two or more selenocysteine residues substituted for two or more cysteine residues
  VARIANT (1)...(453): Xaa = selenocysteine or cysteine
EVQLVESGGGVIQPGGSLRLSXAASGFTFDDYAMNWVRQGPGKGLEWVSAISGDGGSTYYADSVKGRFTISRDNSKNSLYLQMNSLRAEDTAFFYXAKDLRNTIFGVVIPDAFDIWGQGTMVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 630 - protein, 441 aa, Artificial Sequence
  Synthesized sequence with two or more selenocysteine residues substituted for two or more cysteine residues
  VARIANT (1)...(441): Xaa = selenocysteine or cysteine
EVQLVQSGAEVKKPGASVKVSXKASGYTLTSYGISWVRQAPGQGLEWMGWVSFYNGNTNYAQKLQGRGTMTTDPSTSTAYMELRSLRSDDTAVYYXARGYGMDVWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 631 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGVVQPGRSLRLSXSASGFTFSGYGLSWVRQAPGKGLEWVAMISSGGSYTYYADSVKGRFAISRDNAKNTLFLQMDSLRPEDTGVYFXARHGDDPAWFAYWGQGTPVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 632 - protein, 446 aa, Artificial Sequence
  Synthesized sequence with two or more selenocysteine residues substituted for two or more cysteine residues
  VARIANT (1)...(446): Xaa = selenocysteine or cysteine
QVQLVQSGAEVKKPGASVKVSXKVSGFTLTELSIHWVRQAPGKGLEWMGGFDPEDGETIYAQKFQGRVTMTEDTSTDTAYMELTSLRSEDTAVYYXSTIFGVVTNFDNWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 633 - protein, 450 aa, Artificial Sequence
  Synthesized sequence with two or more selenocysteine residues substituted for two or more cysteine residues
  VARIANT (1)...(450): Xaa = selenocysteine or cysteine
QVQLVQSGAEVKKPGASVKVSXKASGYTFTNYYMHWVRQAPGQGLEWVGWINPYTGSAFYAQKFRGRVTMTRDTSISTAYMELSRLRSDDTAVYYXAREPEKFDSDDSDVWGRGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 634 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVQPGAEVKKPGTSVKLSXKASGYTFTTYWMHWVRQAPGQGLEWIGEINPTNGHTNYNQKFQGRATLTVDKSTSTAYMELSSLRSEDTAVYYXARNYVGSIFDYWGQGTLLTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 635 - protein, 450 aa, Artificial Sequence
  Synthesized sequence with two or more selenocysteine residues substituted for two or more cysteine residues
  VARIANT (1)...(450): Xaa = selenocysteine or cysteine
EVQLLESGGGLVQPGGSLRLSXTASGFTFSSYAMNWVRQAPGKGLEWVSAISGSGGTTFYADSVKGRFTISRDNSRTTLYLQMNSLRAEDTAVYYXAKDLGWSDSYYYYYGMDVWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPG

SEQ ID NO: 636 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVQSGSELKKPGASVKISXKASGYTFTSYAMNWVRQAPGQGLESMGWINTNTGNPTYAQGFTGRFVFSMDTSVSTAYLQISSLKAEDTAIYYXAPRYSSSWYLDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 637 - protein, 454 aa, Artificial Sequence
  Synthesized sequence with two or more selenocysteine residues substituted for two or more cysteine residues
  VARIANT (1)...(454): Xaa = selenocysteine or cysteine
QVQLVQSGAEVKRPGASVKVSXKASGYTFTNDIIHWVRQAPGQRLEWMGWINAGYGNTQYSQNFQDRVSITRDTSASTAYMELISLRSEDTAVYYXAREPLWFGESSPHDYYGMDVWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 638 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGAELKKPGSSVKVSXKASGYIFTSSWINWVKQAPGQGLEWIGRIDPSDGEVHYNQDFKDKATLTVDKSTNTAYMELSSLRSEDTAVYYXARGFLPWFADWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 639 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVESGGGVVQPGRSLRLSXAASGFKFSGYGMHWVRQAPGKGLEWVAVIWYDGSKKYYVDSVKGRFTISRDNSKNTLYLQMNSLRAEDTAVYYXARQMGYWHFDLWGRGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPEAEGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 640 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVESGGGAVQPGRSLRLSXAASGFTFSSYGMHWVRQAPGKGLEWVAVILYDGSDKFYADSVKGRFTISRDNSKNTLYLQMNSLRAEDTAVYYXAKVAVAGTHFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 641 - protein, 448 aa, Artificial Sequence
  Synthesized sequence with two or more selenocysteine residues substituted for two or more cysteine residues
  VARIANT (1)...(448): Xaa = selenocysteine or cysteine
EVQLVESGGGLVQPGGSLRLSXAASGFTFSNYWISWVRQAPGKGLEWVAEIRSESDASATHYAEAVKGRFTISRDNAKNSLYLQMNSLRAEDTAVYYXLAYFDYGLAIQNYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPSSIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 642 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGAEVKKPGSSVKVSXKASGYTFSSNVISWVRQAPGQGLEWMGGVIPIVDIANYAQRFKGRVTITADESTSTTYMELSSLRSEDTAVYYXASTLGLVLDAMDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 643 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGLVQPGGSLRLSXAASGFTLRSYSMNWVRQAPGKGLEWVSYISRSSHTIFYADSVKGRFTISRDNAKNSLYLQMDSLRDEDTAMYYXARVYSSGWHVSDYFDYWGQGILVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 644 - protein, 452 aa, Artificial Sequence
  Synthesized sequence with two or more selenocysteine residues substituted for two or more cysteine residues
  VARIANT (1)...(452): Xaa = selenocysteine or cysteine
EVQLQQPGSELVRPGASVKLSXKASGYTFTSYWMHWVKQRPGQGLEWIGNIYPGSRSTNYDEKFKSKATLTVDTSSSTAYMQLSSLTSEDSAVYYXTRNGDYYVSSGDAMDYWGQGTSVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 645 - protein, 445 aa, Artificial Sequence
  Synthesized sequence with two or more selenocysteine residues substituted for two or more cysteine residues
  VARIANT (1)...(445): Xaa = selenocysteine or cysteine
QVQLVQSGAEVKKPGSSVKVSXKASGYTFGNYWMQWVRQAPGQGLEWMGAIYEGTGKTVYIQKFADRVTITADKSTSTAYMELSSLRSEDTAVYYXARLSDYVSGFGYWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEAAGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 646 - protein, 476 aa, Artificial Sequence
  Synthesized sequence with two or more selenocysteine residues substituted for two or more cysteine residues
  VARIANT (1)...(476): Xaa = selenocysteine or cysteine
MKHLWFFLLLVAAPRWVLSQVQLQESGPGLVKPSETLSLTXAVSGGSISGGYGWGWIRQPPGKGLEWIGSFYSSSGNTYYNPSLKSQVTISTDTSKNQFSLKLNSMTAADTAVYYXVRDRLFSVVGMVYNNWFDVWGPGVLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKAEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 647 - protein, 449 aa, Artificial Sequence
  Synthesized sequence with two or more selenocysteine residues substituted for two or more cysteine residues
  VARIANT (1)...(449): Xaa = selenocysteine or cysteine
QVQLQESGPGLVKPSGTLSLTXAVSGGSISSSNWWSWVRQPPGKGLEWIGEIYHSGSTNYNPSLKSRVTISVDKSKNQFSLKLSSVTAADTAVYYXARWTGRTDAFDIWGQGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 648 - protein, 456 aa, Artificial Sequence
  Synthesized sequence with two or more selenocysteine residues substituted for two or more cysteine residues
  VARIANT (1)...(456): Xaa = selenocysteine or cysteine
QVELVESGGGLVQPGGSLRLSXAASGFTFSSYAMSWVRQAPGKGLEWVSAINASGTRTYYADSVKGRFTISRDNSKNTLYLQMNSLRAEDTAVYYXARGKGNTHKPYGYVRYFDVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 649 - protein, 445 aa, Artificial Sequence
  Synthesized sequence with two or more selenocysteine residues substituted for two or more cysteine residues
  VARIANT (1)...(445): Xaa = selenocysteine or cysteine
QVQLQESGPGLVKPSQTLSLTXSFSGFSLSTSGMGVGWIRQPSGKGLEWLAHIWWDGDESYNPSLKSRLTISKDTSKNQVSLKITSVTAADTAVYFXARNRYDPPWFVDWGQGTLVTVSSASTKGPSVFPLAPXSRSTSESTAALGXLVKDYFPEPVTVSWNSGALTSGVHTFPAVLQSSGLYSLSSVVTVTSSNFGTQTYTXNVDHKPSNTKVDKTVERKXXVEXPPXPAPPVAGPSVFLFPPKPKDTLMISRTPEVTXVVVDVSHEDPEVQFNWYVDGMEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPG

SEQ ID NO: 650 - protein, 449 aa, Artificial Sequence
  Synthesized sequence with two or more selenocysteine residues substituted for two or more cysteine residues
  VARIANT (1)...(449): Xaa = selenocysteine or cysteine
DVKLVESGGGLVKLGGSLKLSXAASGFTFSNYYMSWVRQTPEKRLELVAAINSDGGITYYLDTVKGRFTISRDNAKNTLYLQMSSLKSEDTALFYXARHRSGYFSMDYWGQGTSVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 651 - protein, 445 aa, Artificial Sequence
  Synthesized sequence with two or more selenocysteine residues substituted for two or more cysteine residues
  VARIANT (1)...(445): Xaa = selenocysteine or cysteine
QVQLQESGPGLVKPSQTLSLTXTVSGGSISSFNYYWSWIRHHPGKGLEWIGYIYYSGSTYSNPSLKSRVTISVDTSKNQFSLTLSSVTAADTAVYYXARGYNWNYFDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 652 - protein, 446 aa, Artificial Sequence
  Synthesized sequence with two or more selenocysteine residues substituted for two or more cysteine residues
  VARIANT (1)...(446): Xaa = selenocysteine or cysteine
EVQLVQSGAEVKKPGESLKISXKGSGYSFSNYWIGWVRQMPGKGLEWMGIIDPSNSYTRYSPSFQGQVTISADKSISTAYLQWSSLKASDTAMYYXARWYYKPFDVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 653 - protein, 449 aa, Artificial Sequence
  Synthesized sequence with two or more selenocysteine residues substituted for two or more cysteine residues
  VARIANT (1)...(449): Xaa = selenocysteine or cysteine
QVQLQQSGPEVVKPGASVKMSXKASGYTFTSYVIHWVRQKPGQGLDWIGYINPYNDGTDYDEKFKGKATLTSDTSTSTAYMELSSLRSEDTAVYYXAREKDNYATGAWFAYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 654 - protein, 456 aa, Artificial Sequence
  Synthesized sequence with two or more selenocysteine residues substituted for two or more cysteine residues
  VARIANT (1)...(456): Xaa = selenocysteine or cysteine
QAQVVESGGGVVQSGRSLRLSXAASGFAFSSYGMHWVRQAPGKGLEWVAVIWYDGSNKYYADSVRGRFTISRDNSENTLYLQMNSLRAEDTAVYYXARDHYGSGVHHYFYYGLDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 655 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVQSGAEVKKPGASVKVSXKASGYTFTGYWMNWVRQAPGQGLEWMGDIYPGSGNTNYDEKFQGRVTMTRDTSISTAYMELSRLRSDDTAVYYXARGGYYEDFDSWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 656 - protein, 448 aa, Artificial Sequence
  Synthesized sequence with two or more selenocysteine residues substituted for two or more cysteine residues
  VARIANT (1)...(448): Xaa = selenocysteine or cysteine
EVQLLESGGGLVQPGGSLRLSXAASGFTFSIYSMNWVRQAPGKGLEWVSSIGSSGGTTYYADSVKGRFTISRDNSKNTLYLQMNSLRAEDTAVYYXAGSQWLYGMDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 657 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVQSGAEVKKPGSSVKVSXKASGFTFTDYKIHWVRQAPGQGLEWMGYFNPNSGYSTYAQKFQGRVTITADKSTSTAYMELSSLRSEDTAVYYXARLSPGGYYVMDAWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 658 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLVRPGGSLRLSXAASGFTFSNYDMHWVRQATGKGLEWVSAITAAGDIYYPGSVKGRFTISRENAKNSLYLQMNSLRAGDTAVYYXARGRYSGSGSYYNDWFDPWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFEGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 659 - protein, 448 aa, Artificial Sequence
  Synthesized sequence with two or more selenocysteine residues substituted for two or more cysteine residues
  VARIANT (1)...(448): Xaa = selenocysteine or cysteine
QVQLQQSGSELMMPGASVKISXKATGYTFSNYWIEWVKQRPGHGLEWIGEILPGTGRTIYNEKFKGKATFTADISSNTVQMQLSSLTSEDSAVYYXARRDYYGNFYYAMDYWGQGTSVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 660 - protein, 449 aa, Artificial Sequence
  Synthesized sequence with two or more selenocysteine residues substituted for two or more cysteine residues
  VARIANT (1)...(449): Xaa = selenocysteine or cysteine
QVQLQQWGAGLLKPSETLSLTXAVFGGSFSGYYWSWIRQPPGKGLEWIGEINHRGNTNDNPSLKSRVTISVDTSKNQFALKLSSVTAADTAVYYXARERGYTYGNFDHWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 661 - protein, 449 aa, Artificial Sequence; identical to SEQ ID NO: 660
  Synthesized sequence with two or more selenocysteine residues substituted for two or more cysteine residues
  VARIANT (1)...(449): Xaa = selenocysteine or cysteine

SEQ ID NO: 662 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLVQPGGSLRLSXAASGFTFSSSWMNWVRQAPGKGLEWVGRIYPGDGDTNYNVKFKGRFTISRDDSKNSLYLQMNSLKTEDTAVYYXARSGFITTVRDFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 663 - protein, 467 aa, Artificial Sequence; identical to SEQ ID NO: 623
  Synthesized sequence with two or more selenocysteine residues substituted for two or more cysteine residues
  VARIANT (1)...(467): Xaa = selenocysteine or cysteine

SEQ ID NO: 664 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVESGGGVVQPGRSRRLSXAASGFTFSRYTMHWVRQAPGKGLEWVAVISFDGSNKYYVDSVKGRFTISRDNSENTLYLQVNILRAEDTAVYYXAREARGSYAFDIWGQGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 665 - protein, 450 aa, Artificial Sequence
  Synthesized sequence with two or more selenocysteine residues substituted for two or more cysteine residues
  VARIANT (1)...(450): Xaa = selenocysteine or cysteine
QVQLVQSGAEVAKPGTSVKLSXKASGYTFTDYWMQWVKQRPGQGLEWIGTIYPGDGDTGYAQKFQGKATLTADKSSKTVYMHLSSLASEDSAVYYXARGDYYGSNSLDYWGQGTSVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 666 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGLVKPGGSLKLSXAASGFKFSRYAMSWVRQAPGKRLEWVATISSGGSYIYYPDSVKGRFTISRDNVKNTLYLQMSSLRSEDTAMYYXARRDYDLDYFDSWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 667 - protein, 445 aa, Artificial Sequence
  Synthesized sequence with two or more selenocysteine residues substituted for two or more cysteine residues
  VARIANT (1)...(445): Xaa = selenocysteine or cysteine
QVQLVQSGAEVKKPGSSVKVSXKASGYSFTDYHIHWVRQAPGQGLEWMGVINPMYGTTDYNQRFKGRVTITADESTSTAYMELSSLRSEDTAVYYXARYDYFTGTGVYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 668 - protein, 449 aa, Artificial Sequence; identical to SEQ ID NO: 501
  Synthesized sequence with two or more selenocysteine residues substituted for two or more cysteine residues
  VARIANT (1)...(449): Xaa = selenocysteine or cysteine

SEQ ID NO: 669 - protein, 223 aa, Artificial Sequence
  Synthesized sequence with two or more selenocysteine residues substituted for two or more cysteine residues
  VARIANT (1)...(223): Xaa = selenocysteine or cysteine
EVQLVQSGPELKKPGASVKVSXKASGYTFTNYGMNWVRQAPGQGLEWMGWINTYTGETTYADDFKGRFVFSLDTSVSTAYLQISSLKAEDTAVYYXEREGGVNNWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHT

SEQ ID NO: 670 - protein, 451 aa, Artificial Sequence
  Synthesized sequence with two or more selenocysteine residues substituted for two or more cysteine residues
  VARIANT (1)...(451): Xaa = selenocysteine or cysteine
EVQLLESGGGLVQPGGSLRLSXAASGFTFSHYIMMWVRQAPGKGLEWVSGIYSSGGITVYADSVKGRFTISRDNSKNTLYLQMNSLRAEDTAVYYXAYRRIGVPRRDEFDIWGQGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 671 - protein, 439 aa, Artificial Sequence
  Synthesized sequence with two or more selenocysteine residues substituted for two or more cysteine residues
  VARIANT (1)...(439): Xaa = selenocysteine or cysteine
EVQLVESGGGLVQPGGSLRLSXAASGLTFSRYPMSWVRQAPGKGLVWVSAITSSGGSTYYSDTVKGRFTISRDNAKNTLYLQMNSLRAEDTAVYYXARLPDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 672 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVQSGAEVAKPGASVKLSXKASGYTFTSYWMQWVKQRPGQGLEXIGTIYPGDGDTTYTQKFQGKATLTADKSSSTAYMQLSSLRSEDSAVYYXARYDAPGYAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSWRQQGNVFSXSVMHEALHNHYTQKSLSLSPG

SEQ ID NO: 673 - protein, 445 aa, Artificial Sequence
  Synthesized sequence with two or more selenocysteine residues substituted for two or more cysteine residues
  VARIANT (1)...(445): Xaa = selenocysteine or cysteine
QVTLRESGPALVKPTQTLTLTXTVSGFSLSAYSVNWIRQPPGKALEWLAMIWGDGKIVYNSALKSRLTISKDTSKNQVVLTMTNMDPVDTATYYXAGDGYYPYAMDNWGQGSLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 674 - protein, 446 aa, Artificial Sequence
  Synthesized sequence with two or more selenocysteine residues substituted for two or more cysteine residues
  VARIANT (1)...(446): Xaa = selenocysteine or cysteine
QVQLVQSGAEVKKPGASVKVSXKASGYTFTDYSMDWVRQAPGQGLEWMGAIHLNTGYTNYNQKFKGRVTMTRDTSTSTVYMELSSLRSEDTAVYYXARGFYDGYSPMDYWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 675 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVQSGAEVKKPGASVKVSXKASGYSFTNYYIHWVRQAPGQRLEWMGWINAGNGNTKYSQKFQGRVTITRDTSASTAYMELSSLRSEDTAVYYXVRRQRFPYYFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 676 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVQSGGGVERPGGSLRLSXAASGFTFDDYGMSWVRQAPGKGLEWVSGINWNGGSTGYADSVKGRVTISRDNAKNSLYLQMNSLRAEDTAVYYXAKILGAGRGWYFDLWGKGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 677 - protein, 450 aa, Artificial Sequence
  Synthesized sequence with two or more selenocysteine residues substituted for two or more cysteine residues
  VARIANT (1)...(450): Xaa = selenocysteine or cysteine
EVQLVESGGGLVQPGGSLRLSXAASGFSFSDFAMSWVRQAPGKGLEWVATIGRVAFHTYYPDSMKGRFTISRDNSKNTLYLQMNSLRAEDTAVYYXARHRGFDVGHFDFWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 678 - protein, 453 aa, Artificial Sequence
  Synthesized sequence with two or more selenocysteine residues substituted for two or more cysteine residues
  VARIANT (1)...(453): Xaa = selenocysteine or cysteine
QVQLVQSGAEVMKPGSSVKVSXKASGYTFSWYWLEWVRQAPGHGLEWMGEIDPGTFTTNYNEKFKARVTFTADTSTSTAYMELSSLRSEDTAVYYXARFSHFSGSNYDYFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 679 - protein, 443 aa, Artificial Sequence
  Synthesized sequence with two or more selenocysteine residues substituted for two or more cysteine residues
  VARIANT (1)...(443): Xaa = selenocysteine or cysteine
EIQLQQSGPELVKPGASVKVSXKASGYSFTDYNMYWVKQSHGKSLEWIGYIDPYNGDTTYNQKFKGKATLTVDKSSSTAFIHLNSLTSEDSAVYYXARSPYGHYAMDYWGQGTSVTVSSAKTTPPSVYPLAPGSAAQTNSMVTLGXLVKGYFPEPVTVTWNSGSLSSGVHTFPAVLQSDLYTLSSSVTVPSSTWPSETVTXNVAHPASSTKVDKKIVPRDXGXKPXIXTVPEVSSVFIFPPKPKDVLTITLTPKVTXVVVDISKDDPEVQFSWFVDDVEVHTAQTQPREEQFNSTFRSVSELPIMHQDWLNGKEFKXRVNSAAFPAPIEKTISKTKGRPKAPQVYTIPPPKEQMAKDKVSLTXMITDFFPEDITVEWQWNGQPAENYKNTQPIMDTDGSYFVYSKLNVQKSNWEAGNTFTXSVLHEGLHNHHTEKSLSHSPGK

SEQ ID NO: 680 - protein, 450 aa, Artificial Sequence
  Synthesized sequence with two or more selenocysteine residues substituted for two or more cysteine residues
  VARIANT (1)...(450): Xaa = selenocysteine or cysteine
QVQLVQSGAEVKKPGSSVKVSXKASGGTFSFYAISWVRQAPGQGLEWMGGFIPIFGAANYAQKFQGRVTITADESTSTAYMELSSLRSDDTAVYYXARIPSGSYYYDYDMDVWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 681 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVQSGAEVKKPGASVKVSXKASGYTFSTMYMSWVRQAPGQGLEWMGRIDPANEHTNYAQKFQGRVTMTRDTSISTAYMELSRLTSDDTAVYYXARSYYYYNMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPEAAGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 682 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVESGGGVVQPGRSLRLSXAASGFTFSSFGMHWVRQAPGKGLEWVAYISSGSFTIYYADSVKGRFTISRDNSKNTLYLQMNSLRAEDTAVYYXARMRKGYAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 683 - protein, 450 aa, Artificial Sequence
  Synthesized sequence with two or more selenocysteine residues substituted for two or more cysteine residues
  VARIANT (1)...(450): Xaa = selenocysteine or cysteine
QVQLVESGGGVVQPGRSLRLSXAASGFTFSSYGMHWVRQAPGKGLEWVAVISYEESNRYHADSVKGRFTISRDNSKITLYLQMNSLRTEDTAVYYXARDGGIAAPGPDYWGQGTLVTVSSASTKGPSVFPLAPASKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 684 - protein, 450 aa, Artificial Sequence
  Synthesized sequence with two or more selenocysteine residues substituted for two or more cysteine residues
  VARIANT (1)...(450): Xaa = selenocysteine or cysteine
QVQLQQSGPELVKPGASLKLSXTASGFNIKDTYIHWVKQRPEQGLEWIGRIYPTNGYTRYDPKFQDKATITADTSSNTAYLQVSRLTSEDTAVYYXSRWGGDGFYAMDYWGQGASVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELVGGPSVFLLPPKPKDTLMISRTPEVTXVVVDVSHEDPEVKFNWYVDGVEVHNAKTKPPEEQYNSTLRVVSVLTVLHQDWLNGKEYKXKVSNKALPAPIEKTISKAKGQPREPQVYTLPPSRDELTKNQVSLTXLVKGFYPSDIAVEWESNGQPENNYKTTPLVLDSDGSFFLYSKLTVDKSRWQQGNVFSXSVMHEALHNHYTQKSLSLSPGK

SEQ ID NO: 685 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGAEVKKPGASVKVSXKVSGYTLTELSIHWVRQAPGKGLEWMGGFDPEENEIVYAQRFQGRVTMTEDTSTDTAYMELSSLRSEDTAVYYXAIVGSFSPLTLGLWGQGTMVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 686 - protein, 450 aa, Artificial Sequence
  Synthesized sequence with two or more selenocysteine residues substituted for two or more cysteine residues
  VARIANT (1)...(450): Xaa = selenocysteine or cysteine
QVQLQQSGSELKKPGASVKVSXKASGYTFTNYGVNWIKQAPGQGLQWMGWINPNTGEPTFDDDFKGRFAFSLDTSVSTAYLQISSLKADDTAVYFXSRSRGKNEAWFAYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 687 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGAEVVKPGASVKISXKASGYTFTGYFMNWVKQSPGQSLEWIGRIHPYDGDTFYNQKFQGKATLTVDKSSNTAHMELLSLTSEDFAVYYXTRYDGSRAMDYWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 688 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGDLVQPGRSLRLSXAASGFIFSNYGMSWVRQAPGKGLEWVATISSASTYSYYPDSVKGRFTISRDNAKNSLYLQMNSLRVEDTALYYXGRHSDGNFAFGYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 689 - protein, 452 aa, Artificial Sequence
  Synthesized sequence with two or more selenocysteine residues substituted for two or more cysteine residues
  VARIANT (1)...(452): Xaa = selenocysteine or cysteine
QVQLVQSGAEVKKPGASVKVSXKASGYTFTSYWMNWVRQAPGQGLEWMGRIDPYDSETHYAQKLQGRVTMTTDTSTSTAYMELRSLRSDDTAVYYXARGGYDFDVGTLYWFFDVWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 690 - protein, 450 aa, Artificial Sequence
  Synthesized sequence with two or more selenocysteine residues substituted for two or more cysteine residues
  VARIANT (1)...(450): Xaa = selenocysteine or cysteine
QVTLRESGPALVKPTQTLTLTXTFSGFSLSTAGMSVGWIRQPPGKALEWLADIWWDDKKHYNPSLKDRLTISKDTSKNQVVLKVTNMDPADTATYYXARDMIFNFYFDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 691 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVQSGAEVKKPGASVKVSXKAFGYPFTDYLLHWVRQAPGQGLEWVGWLNPYSGDTNYAQKFQGRVTMTRDTSISTAYMELSRLRSDDTAVYYXTRTTLISVYFDYWGQGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 692 - protein, 458 aa, Artificial Sequence
  Synthesized sequence with two or more selenocysteine residues substituted for two or more cysteine residues
  VARIANT (1)...(458): Xaa = selenocysteine or cysteine
EVQLQQSGPDLVKPGASVKISXKASGYSFTGYYMHWVKQSPGKGLEWIGRINPNNGVTLYNQKFKDKATLTVDKSSTTAYMELRSLTSEDSAVYYXARSTMITNYVMDYWGQGTSVTVSSAKTTPPSVYPLAPGSAAQTNSMVTLGXLVKGYFPEPVTVTWNSGSLSSGVHTFPAVLQSDLYTLSSSVTVPSSTWPSETVTXNVAHPASSTKVDKKIVPRDSGGPSEKSEEINEKDLRKKSELQGTALGNLKQIYYYNSKAITSSEKSADQFLTNTLLFKGFFTGHPWYNDLLVDLGSTAATSEYEGSSVDLYGAYYGYQXAGGTPNKTAXMYGGVTLHDNNRLTEEKKVPINLWIDGKQTTVPIDKVKTSKKEVTVQELDLQARHYLHGKFGLYNSDSFGGKVQRGLIVFHSSEGSTVSYDLFDAQGQYPDTLLRIYRDNTTISSTSLSISLYLYTT

SEQ ID NO: 693 - protein, 444 aa, Artificial Sequence
  Synthesized sequence with two or more selenocysteine residues substituted for two or more cysteine residues
  VARIANT (1)...(444): Xaa = selenocysteine or cysteine
QVQVQESGPGLVAPSQTLSITXTVSGFSLTTSGVSWVRQPPGKGLEWLGVIWGDGSTNYHPSLKSRLSIKKDHSKSQVFLKLNSLTAADTATYYXAKGGYSLAHWGQGTLVTVSSASTKGPSVFLPAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 694 - protein, 452 aa, Artificial Sequence
  Synthesized sequence with two or more selenocysteine residues substituted for two or more cysteine residues
  VARIANT (1)...(452): Xaa = selenocysteine or cysteine
EVQLVESGGGLVQPGGSLRLSXAASGFTFSSYLMTWVRQAPGKGLEWVANIKQDGSEKYYVDSVKGRFTISRDNAKNSLNLQMNSLRAEDTAVYYXTRDGYSSGRHYGMDVWGQGTTVIVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 695 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGAEVKKPGASVKVSXKASGYTFTNYWMHWVRQAPGQGLEWMGDINPSNGRTSYKEKFKRRVTLSVDKSSSTAYMELSSLRSEDTAVYFXTIHYDDKYYPLMDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREKMTKNQVSLTXLVKGFYPSDIAVEWESNGQPENNYKTTPPMLKSDGSFFLYSKLTVDKSRWQQGNVFSXSVMHEALHNHYTQKSLSLSPGK

SEQ ID NO: 696 - protein, 451 aa, Artificial Sequence
  Synthesized sequence with two or more selenocysteine residues substituted for two or more cysteine residues
  VARIANT (1)...(451): Xaa = selenocysteine or cysteine
QVQLQESGPGLVKPSQTLSLTXTVSGGSISSGDYYWSWIRQPPGKGLEWIGYIYYSGSTDYNPSLKSRVTMSVDTSKNQFSLKVNSVTAADTAVYYXARVSIFGVGTFDYWGQGTLVTVSSASTKGPSVLPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 697 - protein, 445 aa, Artificial Sequence
  Synthesized sequence with two or more selenocysteine residues substituted for two or more cysteine residues
  VARIANT (1)...(445): Xaa = selenocysteine or cysteine
QVQLVQSGAEVKKPGASVKVSXKASGYTFTGYIMNWVRQAPGQGLEWMGLINPYNGGTDYNPQFQDRVTITADKSTSTAYMELSSLRSEDTAVYYXARDGYDDGPYTLETWGQGTLVTVSSASTKGPSVFPLAPSSKSTSGGTAALGXLVKDYFPEPVTVSWNSGALTSGVHTFPAVLQSSGLYSLSSVVTVPSSNFGTQTYTXNVDHKPSNTKVDKTVERKSXVEXPPXPAPPVAGPSVFLFPPKPKDTLMISRTPEVTXVVVDVSQEDPEVQFNWYVDGVEVHNAKTKPREEQFNSTFRVVSVLTVVHQDWLNGKEYKXKVSNKGLPAPIEKTISKTKGQPREPQVYTLPPSQEEMTKNQVSLTXLVKGFYPSDIAVEWESNGQPENNYKTTPPMLDSDGSFFLYSKLTVDKSRWQEGNVFSXSVMHEALHNHYTQKSLSLSP

SEQ ID NO: 698 - protein, 452 aa, Artificial Sequence
  Synthesized sequence with two or more selenocysteine residues substituted for two or more cysteine residues
  VARIANT (1)...(452): Xaa = selenocysteine or cysteine
EVQLVESGGGLVQPGGSLRLSXAASGFTFSSYDIHWVRQATGKGLEWVSAIGPAGDTYYPGSVKGRFTISRENAKNSLYLQMNSLRAGDTAVYYXARGLITFGGLIAPFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 699 - protein, 440 aa, Artificial Sequence
  Synthesized sequence with two or more selenocysteine residues substituted for two or more cysteine residues
  VARIANT (1)...(440): Xaa = selenocysteine or cysteine
QVQLVESGGGVVQPGRSLRLDXKASGITFSNSGMHWVRQAPGKGLEWVAVIWYDGSKRYYADSVKGRFTISRDNSKNTLFLQMNSLRAEDTAVYYXATNDDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 700 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVQSGAEVKKPGSSVKVSXKASGYAFSYSWINWVRQAPGQGLEWMGRIFPGDGDTDYNGKFKGRVTITADKSTSTAYMELSSLRSEDTAVYYXARNVFDGYWLVYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 701 - protein, 450 aa, Artificial Sequence
  Synthesized sequence with two or more selenocysteine residues substituted for two or more cysteine residues
  VARIANT (1)...(450): Xaa = selenocysteine or cysteine
EVQLVQSGAEVKKPGESLKISXKGSGRTFTSYNMHWVRQMPGKGLEWMGAIYPLTGDTSYNQKSKLQVTISADKSISTAYLQWSSLKASDTAMYYXARSTYVGGDWQFDVWGKGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKIKDTLMISRTPEVTXVVVDVSHEDPEVKFNWYVDGVEVHNAKTKPREEQYNSTYRVVSVLTVLHQDWLNGKEYKXKVSNKALPAPIEKTISKQKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 702 - protein, 450 aa, Artificial Sequence
  Synthesized sequence with two or more selenocysteine residues substituted for two or more cysteine residues
  VARIANT (1)...(450): Xaa = selenocysteine or cysteine
EVQLVESGGGLVQPGGSLRLSXAASGYTFTSYNMHWVRQAPGKGLEWVGAIYPGNGDTSYNQKFKGRFTISVDKSKNTLYLQMNSLRAEDTAVYYXARVVYYSNSYWYFDVWGQGTLVTVSSASTKGPSVFPLAPSSKSTSGGTAALGXLVKDYFPEPVTVSWNSGALTSGVHTFPAVLQSSGLYSLSSWTVPSSSLGTQTYIXNVNHKPSNTKVDKKVEPKSXDKTHTXPPXPAPELLGGPSVFLFPPKPKDTLMISRTPEVTXWVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 703 - protein, 457 aa, Artificial Sequence
  Synthesized sequence with two or more selenocysteine residues substituted for two or more cysteine residues
  VARIANT (1)...(457): Xaa = selenocysteine or cysteine
QLQLQESGPGLVKPSETLSLTXTVSGGSINSSSYYWGWLRQSPGKGLEWIGSFFYTGSTYYNPSLRSRLTISVDTSKNQFSLMLSSVTAADTAVYYXARQSTYYYGSGNYYGWFDRWDQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 704 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVESGGGLVQPGGSLRLSXAASGFNFNDYFMNWVRQAPGKGLEWVAQMRNKNYQYGTYYAESLEGRFTISRDDSKNSLYLQMNSLKTEDTAVYYXARESYYGFTSYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 705 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLVQPGGSLRLSXAVSGYSITSGYSWNWIRQAPGKGLEWVASITYDGSTNYNPSVKGRITISRDDSKNTFYLQMNSLRAEDTAVYYXARGSHYFGHWHFAVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 706 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGLVQPGGSLRLSXAASGYTFTSYWLHWVRQAPGKGLEWVGMIDPSNSDTRFNPNFKDRFTISADTSKNTAYLQMNSLRAEDTAVYYXATYRSYVTPLDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLSXAVKGFYPSDIAVEWESNGQPENNYKTTPPVLDSDGSFFLVSKLTVDKSRWQQGNVFSXSVMHEALHNHYTQKSLSLSPGK

SEQ ID NO: 707 - protein, 454 aa, Artificial Sequence
  Synthesized sequence with two or more selenocysteine residues substituted for two or more cysteine residues
  VARIANT (1)...(454): Xaa = selenocysteine or cysteine
QVQLQESGPGLVRPSQTLSLTXTASGYTFTDYVIHWVKQPPGRGLEWIGYINPYDDDTTYNQKFKGRVTMLVDTSSNTAYLRLSSVTAEDTAVYYXARRGNSYDGYFDYSMDYWGSGTPVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGFFFLYSKLTVDKSRWQQGNVFSXSVMHEALHNHYTQKSLSLSPGK

SEQ ID NO: 708 - protein, 227 aa, Artificial Sequence
  Synthesized sequence with two or more selenocysteine residues substituted for two or more cysteine residues
  VARIANT (1)...(227): Xaa = selenocysteine or cysteine
EVQLLESGGGLVQPGGSLRLSXAASGFTFSIYPMFWVRQAPGKGLEWVSWIGPSGGITKYADSVKGRFTISRDNSKNTLYLQMNSLRAEDTATYYXAREGHNDWYFDLWGRGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPP

SEQ ID NO: 709 - protein, 451 aa, Artificial Sequence
  Synthesized sequence with two or more selenocysteine residues substituted for two or more cysteine residues
  VARIANT (1)...(451): Xaa = selenocysteine or cysteine
EVQLLESGGGLVQPGGSLRLSXAASGFTFSNAWMSWVRQAPGKGLEWVSSISVGGHRTYYADSVKGRSTISRDNSKNTLYLQMNSLRAEDTAVYYXARIRVGPSGGAFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 710 - protein, 449 aa, Artificial Sequence
  Synthesized sequence with two or more selenocysteine residues substituted for two or more cysteine residues
  VARIANT (1)...(449): Xaa = selenocysteine or cysteine
EVQLLESGGGLVQPGGSLRLSXAASGFTFSSFPMAWVRQAPGKGLEWVSTISTSGGRTYYRDSVKGRFTISRDNSKNTLYLQMNSLRAEDTAVYYXAKFRQYSGGFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYASTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 711 - protein, 449 aa, Artificial Sequence
  Synthesized sequence with two or more selenocysteine residues substituted for two or more cysteine residues
  VARIANT (1)...(449): Xaa = selenocysteine or cysteine
EVQLLESGGGLVQPGGSLRLSXAASGFTFNSYAMSWVRQAPGKGLEWVSIISGSGGFTYYADSVKGRFTISRDNSRTTLYLQMNSLRAEDTAVYYXAKDRLVAPGTFDYWGQGALVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 712 - protein, 443 aa, Artificial Sequence
  Synthesized sequence with two or more selenocysteine residues substituted for two or more cysteine residues
  VARIANT (1)...(443): Xaa = selenocysteine or cysteine
QVQLVQSGAEVKKPGASVKVSXKASGYTFTSYWMHWVRQAPGQGLEWIGNINPSNGGTNYNEKFKSKATMTRDTSTSTAYMELSSLRSEDTAVYYXELMQGYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELAGAPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 713 - protein, 450 aa, Artificial Sequence
  Synthesized sequence with two or more selenocysteine residues substituted for two or more cysteine residues
  VARIANT (1)...(450): Xaa = selenocysteine or cysteine
QVTLRESGPALVKPTQTLTLTXTFSGFSLSTSGMSVGWIRQPPGKALEWLADIWWDDKKDYNPSLKSRLTISKDTSKNQVVLKVTNMDPADTATYYXARSMITNWYFDVWGAGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 714 - protein, 449 aa, Artificial Sequence
  Synthesized sequence with two or more selenocysteine residues substituted for two or more cysteine residues
  VARIANT (1)...(449): Xaa = selenocysteine or cysteine
EGQLVQSGGGLVHPGGSLRLSXAGSGFTFSSYGMHWVRQAPGKGLEWVSGIGTGGGTYSTDSVKGRFTISRDNAKNSLYLQMNSLRAEDMAVYYXARGDYYGSGSFFDXWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 715 - protein, 445 aa, Artificial Sequence
  Synthesized sequence with two or more selenocysteine residues substituted for two or more cysteine residues
  VARIANT (1)...(445): Xaa = selenocysteine or cysteine
QVQLQESGPGLVKPSETLSLTXTVSGGSVSSGDYYWTWIRQSPGKGLEWIGHIYYSGNTNYNPSLKSRLTISIDTSKTQFSLKLSSVTAADTAIYYXVRDRVTGAFDIWGQGTMVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 716 - protein, 453 aa, Artificial Sequence
  Synthesized sequence with two or more selenocysteine residues substituted for two or more cysteine residues
  VARIANT (1)...(453): Xaa = selenocysteine or cysteine
EVQLVESGGGLVQPGGSLRLSXAASGYTFIDYYMNWVRQAPGKGLEWVGDINLDNSGTHYNQKFKGRFTISRDKSKNTAYLQMNSLRAEDTAVYYXAREGVYHDYDDYAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 717 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVESGGGLVQPGGSLRLSXAASGYTFTSYVIHWVRQAPGKGLEWVGYNNPYNAGTNYNEKFKGRFTISSDKSKNTAYLQMNSLRAEDTAVYYXSRPTMLPWFAYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 718 - protein, 447 aa, Artificial Sequence
  Synthesized sequence with two or more selenocysteine residues substituted for two or more cysteine residues
  VARIANT (1)...(447): Xaa = selenocysteine or cysteine
QVQLQQWGAGLLKPSETLSLTXAVYGGSFSGYYWSWIRQPPGKGLEWIGEINHSGSTNYNPSLKSRVTISVETSKNQFSLKLSSVTAADTAVYYXARDKWTWYFDLWGRGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 719 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGVEVKKPGASVKVSXKASGYTFTNYYMYWVRQAPGQGLEWMGGINPSNGGTNFNEKFKNRVTLTTDSSTTTAYMELKSLQFDDTAVYYXARRDYRFDMGFDYWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 720 - protein, 452 aa, Artificial Sequence
  Synthesized sequence with two or more selenocysteine residues substituted for two or more cysteine residues
  VARIANT (1)...(452): Xaa = selenocysteine or cysteine
EVQLVESGGGLVQPGGSLRLSXAASGFTFSDYTMLWVRQAPGKGLEWVAIIKSGGSYSYYPDSVKGRFTISRDNAKNSLYLQMNSLRAEDTAVYYXARDGDYGSSYGAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPEAAGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 721 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGSELKKPGASVKISXKASGYTFTNYGMNWVRQAPGQGLQWMGWINTDSGESTYAEEFKGRFVFSLDTSVNTAYLQITSLTAEDTGMYFXVRVGYDALDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 722 - protein, 450 aa, Artificial Sequence
  Synthesized sequence with two or more selenocysteine residues substituted for two or more cysteine residues
  VARIANT (1)...(450): Xaa = selenocysteine or cysteine
EVQLVESGGGLVQPGGSLRLSXAASGYEFSRSWMNWVRQAPGKGLEWVGRIYPGDGDTNYSGKFKGRFTISADTSKNTAYLQMNSLRAEDTAVYYXARDGSSWDWYFDVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 723 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVESGGGLVKPGGSLRLSXAASGFTFSAYAMNWVRQAPGKGLEWVGRIRTKNNNYATYYADSVKDRFTISRDDSKNTLYLQMNSLKTEDTAVYYXTTFYGNGVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELAGAPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 724 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVQSGAEVKKPGASVKVSXKASGYTFTDSYMSWVRQAPGQGLEWIGDMYPDNGDSSYNQKFRERVTITRDTSTSTAYLELSSLRSEDTAVYYXVLAPRWYFSVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 725 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVESGGGLVQPGGSLRLSXAASGYTFSSYWIEWVRQAPGKGLEWIGEILPGGGDTNYNEIFKGRATFSADTSKNTAYLQMNSLRAEDTAVYYXTRRVPIRLDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 726 - protein, 442 aa, Artificial Sequence
  Synthesized sequence with two or more selenocysteine residues substituted for two or more cysteine residues
  VARIANT (1)...(442): Xaa = selenocysteine or cysteine
QVQLVQSGAEVKKPGASVKVSXKASGYYTEAYYIHWVRQAPGQGLEWMGRIDPATGNTKYAPRLQDRVTMTRDTSTSTVYMELSSLRSEDTAVYYXASLYSLPVYWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPSSIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 727 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVESGGGLVQPGGSLRLSXAASGFTFSSYWMSWVRQAPGKGLEWVAYIKQDGNEKYYVDSVKGRFTISRDNAKNSLYLQMNSLRAEDTAVYYXAREGILWFGDLPTFWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 728 - protein, 454 aa, Artificial Sequence
  Synthesized sequence with two or more selenocysteine residues substituted for two or more cysteine residues
  VARIANT (1)...(454): Xaa = selenocysteine or cysteine
QVQLQESGAELVRSGASVRMSXKASGYTFTSYNMHWVKQTPGQGLEWIGYIYPGNGGTNYIQKFKGKAILTADTSSSTAYMQISSLTSEDSAVYFXTRSPSHYSSDPYFDYWGQGTTLTVSSEFASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 729 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVESGGGLVQPGGSLRLSXAASGFTFSDYGIAWVRQAPGKGLEWVAFISDLAYTIYYADTVTGRFTISRDNSKNTLYLQMNSLRAEDTAVYYXARDNWDAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 730 - protein, 445 aa, Artificial Sequence
  Synthesized sequence with two or more selenocysteine residues substituted for two or more cysteine residues
  VARIANT (1)...(445): Xaa = selenocysteine or cysteine
QVQLQQSGAELVKPGASVKLSXKASGYTFTSYDINWVRQRPEQGLEWIGWIFPGDGSTKYNEKFKGKATLTTDKSSSTAYMQLSRLTSEDSAVYFXAREDYYDNSYYFDYWGQGTTLTVSSAKTTPPSVYPLAPGSAAQTNSMVTLGXLVKGYFPEPVTVTWNSGSLSSGVHTFPAVLQSDLYTLSSSVTVPSSPRPSETVTXNVAHPASSTKVDKKIVPRDXGXKPXIXTVPEVSSVFIFPPKPKDVLTITLTPKVTXVVVDISKDDPEVQFSWFVDDVEVHTAQTQPREEQFNSTFRSVSELPIMHQDWLNGKEFKXRVNSAAFPAPIEKTISKTKGRPKAPQVYTIPPPKEQMAKDKVSLTXMITDFFPEDITVEWQWNGQPAENYKNTQPIMNTNGSYFVYSKLNVQKSNWEAGNTFTXSVLHEGLHNHHTEKSLSHSPGK

SEQ ID NO: 731 - protein, 456 aa, Artificial Sequence
  Synthesized sequence with two or more selenocysteine residues substituted for two or more cysteine residues
  VARIANT (1)...(456): Xaa = selenocysteine or cysteine
QVQLVQSGAEVKKPGSSVKVSXKASGGTFNRYTVNWVRQAPGQGLEWMGGIIPIFGTANYAQRFQGRLTITADESTSTAYMELSSLRSDDTAVYFXARENLDNSGTYYYFSGWFDPWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 732 - protein, 444 aa, Artificial Sequence
  Synthesized sequence with two or more selenocysteine residues substituted for two or more cysteine residues
  VARIANT (1)...(444): Xaa = selenocysteine or cysteine
QVQLVQSGAEVKKPGASVKVSXKASGYTFTSYYMHWVRQAPGQGLEWMGEIHPSGGRTNYNEKFKSRVTMTRDTSTSTVYMELSSLRSEDTAVYYXARERPLYASDLWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPSSIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 733 - protein, 446 aa, Artificial Sequence
  Synthesized sequence with two or more selenocysteine residues substituted for two or more cysteine residues
  VARIANT (1)...(446): Xaa = selenocysteine or cysteine
EVQLVQSGGGLVKPGGSLRLSXAASGFTFSSYSMNWVRQAPGKGLEWVSSISSSSSYIYYADSVKGRFTISRDNAKNSLYLQMNSLRAEDTAVYYXARVTDAFDIWGQGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 734 - protein, 456 aa, Artificial Sequence
  Synthesized sequence with two or more selenocysteine residues substituted for two or more cysteine residues
  VARIANT (1)...(456): Xaa = selenocysteine or cysteine
QVQLVQSGSELKKPGASVKVSXKASGYTFTNYGMNWVRQAPGQGLEWMGWINTYTGEPTYADDFTGRFVFSLDTSVSTAYLQISSLKAEDTAVYYXARNPINYYGINYEGYVMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELAGAPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 735 - protein, 587 aa, Artificial Sequence
  Synthesized sequence with two or more selenocysteine residues substituted for two or more cysteine residues
  VARIANT (1)...(587): Xaa = selenocysteine or cysteine
EVQLVESGGGLVQPGRSLRLSXAASGFTFDDYAMHWVRQAPGKGLEWVSAITWNSGHIDYADSVEGRFTISRDNAKNSLYLQMNSLRAEDTAVYYXAKVSYLSTASSLDYWGQGTLVTVSSGGGGSGGGGSEVQLVQSGAEVKKPGSSVKVSXKASGGSFGGYGIGWVRQAPGQGLEWMGGITPFFGFADYAQKFQGRVTITADESTTTAYMELSGLTSDDTAVYYXARDPNEFWNGYYSTHDFDSWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 736 - protein, 446 aa, Artificial Sequence
  Synthesized sequence with two or more selenocysteine residues substituted for two or more cysteine residues
  VARIANT (1)...(446): Xaa = selenocysteine or cysteine
QVQLQESGPGLVKPSETLSLTXTVSGGSISIYYWSWIRQPPGKGLEWIGYVYYSGSTNYNPSLKSRVTISVDTSKNQFSLKLNSVTAADTAVYYXARGGYDFWSGYFDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 737 - protein, 449 aa, Artificial Sequence
  Synthesized sequence with two or more selenocysteine residues substituted for two or more cysteine residues
  VARIANT (1)...(449): Xaa = selenocysteine or cysteine
QLQLQESGPGLVKPSETLSLTXTVSGGSITSSSYYWGWIRQPPGKGLEWIGSIYYRGSTNYNPSLKSRVTISVDSSKNQFYLKVSSVTAVDTAVYYXARQNGAARPSWFDPWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 738 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVQSGAEVKKPGSSVKVSXKASGYTFTDQTIHWMRQAPGQGLEWIGYIYPRDDSPKYNENFKGKVTITADKSTSTAYMELSSLRSEDTAVYYXAIPDRSGYAWFIYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPEAAGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 739 - protein, 224 aa, Artificial Sequence
  Synthesized sequence with two or more selenocysteine residues substituted for two or more cysteine residues
  VARIANT (1)...(224): Xaa = selenocysteine or cysteine
QVQLQQPGAELVKPGASVKMSXKASGYTFTSYNMHWVKQTPGRGLEWIGAIYPGNGDTSYNQKFKGKATLTADKSSSTAYMQLSSLTSEDSAVYYXARSTYYGGDWYFNVWGAGTTVTVSAASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSX

SEQ ID NO: 740 - protein, 448 aa, Artificial Sequence
  Synthesized sequence with two or more selenocysteine residues substituted for two or more cysteine residues
  VARIANT (1)...(448): Xaa = selenocysteine or cysteine
EVQLVQSGGGLVKPGGSLRLSXAASGFTFSSFAMHWVRQAPGKGLEWISVIDTRGATYYADSVKGRFTISRDNAKNSLYLQMNSLRAEDTAVYYXARLGNFYYGMDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 741 - protein, 456 aa, Artificial Sequence; identical to SEQ ID NO: 502
  Synthesized sequence with two or more selenocysteine residues substituted for two or more cysteine residues
  VARIANT (1)...(456): Xaa = selenocysteine or cysteine

SEQ ID NO: 742 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVQSGAEVKKPGASVKVSXKASGYTFTDYNMHWVRQAPGQGLEWMGEINPNSGGAGYNQKFKGRVTMTTDTSTSTAYMELRSLRSDDTAVYYXARLGYDDIYDDWYFDVWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 743 - protein, 447 aa, Artificial Sequence
  Synthesized sequence with two or more selenocysteine residues substituted for two or more cysteine residues
  VARIANT (1)...(447): Xaa = selenocysteine or cysteine
EVQLVESGGGLVQPGGSLRLSXATSGYTFTEYIIHWVRQAPGKGLEWVASINPDYDITNYNQRFKGRFTISLDKSKRTAYLQMNSLRAEDTAVYYXASWISDFFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 744 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGAEVKKPGASVKVSXKASGYTFTDYSIHWVRQAPGQGLEWIGYIYPSNGDSGYNQKFKNRVTMTRDTSTSTAYMELSRLRSEDTAVYYXATYFANNFDYWGQGTTLTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 745 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGAEVKKPGASVKVSXKASGYTFTNYGMNWVRQAPGQGLEWMGWINTYTGEPTYADDFKGRVTMTTDTSTSTAYMELRSLRSDDTAVYYXARIGDSSPSDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 746 - protein, 444 aa, Artificial Sequence
  Synthesized sequence with two or more selenocysteine residues substituted for two or more cysteine residues
  VARIANT (1)...(444): Xaa = selenocysteine or cysteine
EVPLVESGGGLVQPGGSLRLSXAVSGFTFSNYGMVWVRQAPGKGLEWVAYIDSDGDNTYYRDSVKGRFTISRDNAKSSLYLQMNSLRAEDTAVYYXTTGIVRPFLYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 747 - protein, 469 aa, Artificial Sequence
  Synthesized sequence with two or more selenocysteine residues substituted for two or more cysteine residues
  VARIANT (1)...(469): Xaa = selenocysteine or cysteine
MGWSXIILFLVATATGVHSVQLQQSGSELKKPGASVKVSXKASGYTFTNYGMNWVKQAPGQGLKWMGWINTYTGEPTYTDDFKGRFAFSLDTSVSTAYLQISSLKADDTAVYFXARGGFGSSYWYFDVWGQGSLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 748 - protein, 442 aa, Artificial Sequence
  Synthesized sequence with two or more selenocysteine residues substituted for two or more cysteine residues
  VARIANT (1)...(442): Xaa = selenocysteine or cysteine
QVQLQQSGSELKKPGASVKISXKASGYSFTDYIILWVRQNPGKGLEWIGHIDPYYGSSNYNLKFKGRVTITADQSTTTAYMELSSLRSEDTAVYYXGRSKRDYFDYWGQGTTLTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 749 - protein, 443 aa, Artificial Sequence
  Synthesized sequence with two or more selenocysteine residues substituted for two or more cysteine residues
  VARIANT (1)...(443): Xaa = selenocysteine or cysteine
QVQLQESGPGLVKPSETLSLTXAVSGHSISHDHAWSWVRQPPGEGLEWIGFISYSGITNYNPSLQGRVTISRDNSKNTLYLQMNSLRAEDTAVYYXARSLARTTAMDYWGEGTLVTVSSASTKGPSVFPLAPSSKSTSGGTAALGXLVKDYFPEPVTVSWNSGALTSGVHTFPAVLQSSGLYSLSSVVTVPSSNFGTQTYTXNVDHKPSNTKVDKTVERKSXVEXPPXPAPPVAGPSVFLFPPKPKDTLMISRTPEVTXVVVDVSQEDPEVQFNWYVDGVEVHNAKTKPREEQFNSTFRVVSVLTVVHQDWLNGKEYKXKVSNKGLPAPIEKTISKTKGQPREPQVYTLPPSQEEMTKNQVSLTXLVKGFYPSDIAVEWESNGQPENNYKTTPPMLDSDGSFFLYSKLTVDKSRWQEGNVFSXSVMHEALHAHYTQKSLSLSP

SEQ ID NO: 750 - protein, 446 aa, Artificial Sequence
  Synthesized sequence with two or more selenocysteine residues substituted for two or more cysteine residues
  VARIANT (1)...(446): Xaa = selenocysteine or cysteine
EVQLVESGGGLVQPGRSLRLSXAASRFTFDDYAMHWVRQAPGKGLEWVSGISWNSGRIGYADSVKGRFTISRDNAENSLFLQMNGLRAEDTALYYXAKGRDSFDIWGQGTMVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 751 - protein, 457 aa, Artificial Sequence
  Synthesized sequence with two or more selenocysteine residues substituted for two or more cysteine residues
  VARIANT (1)...(457): Xaa = selenocysteine or cysteine
EVQLVESGGGLVQPGGSLRLSXAASGFTFSNYWMNWVRQAPGKGLEWVAAINQDGSEKYYVGSVKGRFTISRDNAKNSLYLQMNSLRVEDTAVYYXVRDYYDILTDYYIHYWYFDLWGRGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 752 - protein, 445 aa, Artificial Sequence
  Synthesized sequence with two or more selenocysteine residues substituted for two or more cysteine residues
  VARIANT (1)...(445): Xaa = selenocysteine or cysteine
EVQLLESGGGLVQPGGSLRLSXAASGFTFSHYVMAWVRQAPGKGLEWVSSISSSGGWTLYADSVKGRFTISRDNSKNTLYLQMNSLRAEDTAVYYXTRGLKMATIFDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 753 - protein, 451 aa, Artificial Sequence
  Synthesized sequence with two or more selenocysteine residues substituted for two or more cysteine residues
  VARIANT (1)...(451): Xaa = selenocysteine or cysteine
EVQLQQPGPELEKPGASVKLSXKASGYSFTDYNMNWVKQNNGESLEWIGKIDPYYGGPSYNQKFKDKATLTVDKSSSTAYMQLKSLTSEDSAVYYXTRGGNRDWYFDVWGAGTTLTVSAEFASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 754 - protein, 446 aa, Artificial Sequence
  Synthesized sequence with two or more selenocysteine residues substituted for two or more cysteine residues
  VARIANT (1)...(446): Xaa = selenocysteine or cysteine
QVQLVQSGAEVKKPGASVKVSXKASGYTFTSYSISWVRQAPGQGLEWMGWISVYNGNTNYAQKFQGRVTMTTDTSTSTAYLELRSLRSDDTAVYYXARDPIAAGYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 755 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGKLLKPGGSLKLSXAASGFTFSSFAMSWFRQSPEKRLEWVAEISSGGSYTYYPDTVTGRFTISRDNAKNTLYLEMSSLRSEDTAMYYXARGLWGYYALDYWGQGTSVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 756 - protein, 443 aa, Artificial Sequence
  Synthesized sequence with two or more selenocysteine residues substituted for two or more cysteine residues
  VARIANT (1)...(443): Xaa = selenocysteine or cysteine
QVQLVQSGAEVKKPGASVKVSXKASGYAFTYYLIEWVRQAPGQGLEWIGVINPGSGGTNYNEKFKGRATITADKSTSTAYMELSSLRSEDTAVYFXARNWMNFDYWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 757 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGLVQPGGSLRLSXAASGFTFSPFAMSWVRQAPGKGLEWVAKISPGGSWTYYSDTVTGRFTISRDNAKNSLYLQMNSLRAEDTAVYYXARQLWGYYALDIWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 758 - protein, 446 aa, Artificial Sequence
  Synthesized sequence with two or more selenocysteine residues substituted for two or more cysteine residues
  VARIANT (1)...(446): Xaa = selenocysteine or cysteine
EVQLVESGGGLVQPGGSLRLSXAASGYSITNDYAWNWVRQAPGKGLEWVGYISYSGYTTYNPSLKSRFTISRDTSKNTLYLQMNSLRAEDTAVYYXARWTSGLDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 759 - protein, 441 aa, Artificial Sequence
  Synthesized sequence with two or more selenocysteine residues substituted for two or more cysteine residues
  VARIANT (1)...(441): Xaa = selenocysteine or cysteine
EVQLVESGGGLVQPGGSLRLSXAASGFTFSRYSMSWVRQAPGKGLELVAQINSVGNSTYYPDTVKGRFTISRDNAKNTLYLQMNSLRAEDTAVYYXASGDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 760 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVQSGAEVKKPGASVKVSXKASGYTFTNSWIGWFRQAPGQGLEWIGDIYPGGGYTNYNEIFKGKATMTADTSTNTAYMELSSLRSEDTAVYYXSRGIPGYAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 761 - protein, 450 aa, Artificial Sequence
  Synthesized sequence with two or more selenocysteine residues substituted for two or more cysteine residues
  VARIANT (1)...(450): Xaa = selenocysteine or cysteine
QVQLQQWGAGLLKPSETLSLTXAVYGGSFSGYYWSWIRQPPGKGLEWIGEINHSGSTNYNPSLKSRVTISVDTSKNQFSLKLSSVTAADTAVYYXARGYYDILTGYYYYFDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 762 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVQSGAEVKKPGSSVKVSXKASGYAFTNYLIEWVRQAPGQGLEWIGVIYPGSGGTNYNEKFKGRVTLTVDESTNTAYMELSSLRSEDTAVYFXARRDGNYGWFAYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 763 - protein, 447 aa, Artificial Sequence
  Synthesized sequence with two or more selenocysteine residues substituted for two or more cysteine residues
  VARIANT (1)...(447): Xaa = selenocysteine or cysteine
QVQLQESGPGLVKPSETLSLTXTVSGFSLIGYDLNWIRQPPGKGLEWIGIIWGDGTTDYNSAVKSRVTISKDTSKNQFSLKLSSVTAADTAVYYXARGGYWYATSYYFDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPSSIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 764 - protein, 441 aa, Artificial Sequence
  Synthesized sequence with two or more selenocysteine residues substituted for two or more cysteine residues
  VARIANT (1)...(441): Xaa = selenocysteine or cysteine
EVQLVESGGGLVQPGGSLRLSXAASGFTFSSSGMSWVRQAPGKGLEWVSVIASSGSNTYYADSVKGRFTISRDNSKNTLYLQMNSLRAEDTAVYYXARSIFYTTWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 765 - protein, 451 aa, Artificial Sequence
  Synthesized sequence with two or more selenocysteine residues substituted for two or more cysteine residues
  VARIANT (1)...(451): Xaa = selenocysteine or cysteine
QVQLQESGPGLVKPSQTLSLTXAVYGGSFSSGYWNWIRKHPGKGLEYIGYISYNGITYHNPSLKSRITINRDTSKNQYSLQLNSVTPEDTAVYYXARYKYDYDGGHAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 766 - protein, 445 aa, Artificial Sequence
  Synthesized sequence with two or more selenocysteine residues substituted for two or more cysteine residues
  VARIANT (1)...(445): Xaa = selenocysteine or cysteine
QVQLVQSGAEVKKPGASVKVSXKASGYIFTAYTMHWVRQAPGQGLEWMGWIKPNNGLANYAQKFQGRVTMTRDTSISTAYMELSRLRSDDTAVYYXARSEITTEFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDXHXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 767 - protein, 456 aa, Artificial Sequence
  Synthesized sequence with two or more selenocysteine residues substituted for two or more cysteine residues
  VARIANT (1)...(456): Xaa = selenocysteine or cysteine
EIQLQQSGPELVKPGASVKVSXKASGYAFTSYNMYWVKQSHGKSLEWIGYIDPYNGVTSYNQKFKGKATLTVDKSSSTAYMHLNSLTSEDSAVYYXARGGGSIYYAMDYWGQGTSVTVSSAKTTPPSVYPLAPGXGDTTGSSVTLGXLVKGYFPESVTVTWNSGSLSSSVHTFPALLQSGLYTMSSSVTVPSSTWPSQTVTXSVAHPASSTTVDKKLEPSGPISTINPXPPXKEXHKXPAPNLEGGPSVFIFPPNIKDVLMISLTPKVTXVVVDVSEDDPDVQISWFVNNVEVHTAQTQTHREDYNSTIRVVSTLPIQHQDWMSGKEFKXKVNNKDLPSPIERTISKIKGLVRAPQVYILPPPAEQLSRKDVSLTXLVVGFNPGDISVEWTSNGHTEENYKDTAPVLDSDGSYFIYSKLNMKTSKWEKTDSFSXNVRHEGLKNYYLKKTISRSPGK

SEQ ID NO: 768 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVQSGGGVVQPGRSLRLSXKASGYTFTRYTMHWVRQAPGKGLEWIGYINPSRGYTNYNQKVKDRFTISRDNSKNTAFLQMDSLRPEDTGVYFXARYYDDHYXLDYWGQGTPVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPEAAGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 769 - protein, 448 aa, Artificial Sequence
  Synthesized sequence with two or more selenocysteine residues substituted for two or more cysteine residues
  VARIANT (1)...(448): Xaa = selenocysteine or cysteine
QVELVESGGGVVQPGRSQRLSXAASGFTFSSYGMHWVRQAPGKGLEWVAIIWFDGSSTYYADSVRGRFTISRDNSKNTLYLQMNSLRAEDTAVYFXARELGRRYFDLWGRGTLVSVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 770 - protein, 446 aa, Artificial Sequence
  Synthesized sequence with two or more selenocysteine residues substituted for two or more cysteine residues
  VARIANT (1)...(446): Xaa = selenocysteine or cysteine
EVQLVQSGAEVKKPGSSVKVSXKASGGTFSSYAISWVRQAPGQGLEWMGGIGPFFGTANYAQKFQGRVTITADESTSTAYMELSSLRSEDTAVYYXARDTPYFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPEAAGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 771 - protein, 448 aa, Artificial Sequence
  Synthesized sequence with two or more selenocysteine residues substituted for two or more cysteine residues
  VARIANT (1)...(448): Xaa = selenocysteine or cysteine
QMQLVESGGGVVQPGRSLRLSXAASGFTFRTYGMHWVRQAPGKGLEWVAVIWYDGSNKHYADSVKGRFTITRDNSKNTLNLQMNSLRAEDTAVYYXARAPQWELVHEAFDIWGQGTMVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 772 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGLVQPGGSLRLSXAASGFTFSSYVMSWVRQAPGKGLEWVATISSGGSYTYYPDSVKGRFTISRDNAKNTLYLQMNSLRAEDTAVYYXARRGDSMITTDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 773 - protein, 446 aa, Artificial Sequence
  Synthesized sequence with two or more selenocysteine residues substituted for two or more cysteine residues
  VARIANT (1)...(446): Xaa = selenocysteine or cysteine
QVQLVQSGAEVKKPGASVKVSXKASGYIFITYWMTWVRQAPGQGLEWMGQIFPASGSADYNEKFEGRVTMTTDTSTSTAYMELRSLRSDDTAVYYXARGGGGFAYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 774 - protein, 448 aa, Artificial Sequence
  Synthesized sequence with two or more selenocysteine residues substituted for two or more cysteine residues
  VARIANT (1)...(448): Xaa = selenocysteine or cysteine
EVQLLESGGGLVQPGGSLRLSXAASGFTFSNYAMSWVRQAPGKGLEWVSSISGSGDYTYYTDSVKGRFTISRDNSKNTLYLQMNSLRAEDTAVYYXARSPWGYYLDSWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 775 - protein, 448 aa, Artificial Sequence
  Synthesized sequence with two or more selenocysteine residues substituted for two or more cysteine residues
  VARIANT (1)...(448): Xaa = selenocysteine or cysteine
QVQLQESGPGLVRPSQTLSLTXTVSGYSITSDHAWSWVRQPPGRGLEWIGYISYSGITTYNPSLKSRVTMLRDTSKNQFSLRLSSVTAADTAVYYXARSLARTTAMDYWGQGSLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 776 - protein, 446 aa, Artificial Sequence
  Synthesized sequence with two or more selenocysteine residues substituted for two or more cysteine residues
  VARIANT (1)...(446): Xaa = selenocysteine or cysteine
QVQLVESGGGLVKPGGSLRLSXAASGFTFSDYYMNWIRQAPGKGLEWVSYISSSGSIIYYADSVKGRFTISRDNAKNSLYLQMNSLRAEDTAVYYXAREGRIAARGMDVWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 777 - protein, 449 aa, Artificial Sequence
  Synthesized sequence with two or more selenocysteine residues substituted for two or more cysteine residues
  VARIANT (1)...(449): Xaa = selenocysteine or cysteine
QVQLVQSGAEVKKPGASVKVSXKASGYTFTNYGLSWVRQAPGQGLEWMGWISANNGDTNYGQEFQGRVTMTTDTSTSTAYMELRSLRSDDTAVYYXARDSSSSWARWFFDLWGRGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 778 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVESGGGLVQPGGSLRLSXAASGFNIKDTYIHWVRQAPGKGLEWVARIYPTNGYTRYADSVKGRFTISADTSKNTAYLQMNSLRAEDTAVYYXSRWGGDGFYAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 779 - protein, 449 aa, Artificial Sequence; identical to SEQ ID NO: 778
  Synthesized sequence with two or more selenocysteine residues substituted for two or more cysteine residues
  VARIANT (1)...(449): Xaa = selenocysteine or cysteine

SEQ ID NO: 780 - protein, 454 aa, Artificial Sequence
  Synthesized sequence with two or more selenocysteine residues substituted for two or more cysteine residues
  VARIANT (1)...(454): Xaa = selenocysteine or cysteine
EEQLVESGGGLVKPGGSLRLSXAASGFSFSDXRMYWLRQAPGKGLEWIGVISVKSENYGANYAESVRGRFTISRDDSKNTVYLQMNSLKTEDTAVYYXSASYYRYDVGAWFAYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 781 - protein, 451 aa, Artificial Sequence
  Synthesized sequence with two or more selenocysteine residues substituted for two or more cysteine residues
  VARIANT (1)...(451): Xaa = selenocysteine or cysteine
QVQLVESGGGVVQPGRSLRLSXAASGFTFSSYGMHWVRQAPGKGLEWVAVIWYDGSNKYYADSVKGRFTISRDNSKNTLYLQMNSLRAEDTAVYYXARDPRGATLYYYYYGMDVWGQGTTVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 782 - protein, 447 aa, Artificial Sequence
  Synthesized sequence with two or more selenocysteine residues substituted for two or more cysteine residues
  VARIANT (1)...(447): Xaa = selenocysteine or cysteine
EVQVLESGGDLVQPGGSLRLSXAASGFTFSAYAMTWVRQAPGKGLEWVSAISGSGGSAYYADSVKGRFTISRDNSKNTVYLQMNSLRAEDTAVYYXAKDGAWKMSGLDVWGQGTTVIVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 783 - protein, 448 aa, Artificial Sequence
  Synthesized sequence with two or more selenocysteine residues substituted for two or more cysteine residues
  VARIANT (1)...(448): Xaa = selenocysteine or cysteine
QAYLQQSGAELVRPGASVKMSXKASGYTFTSYNMHWVKQTPRQGLEWIGGIYPGNGDTSYNQKFKGKATLTVGKSSSTAYMQLSSLTSEDSAVYFXARYDYNYAMDYWGQGTSVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 784 - protein, 451 aa, Artificial Sequence
  Synthesized sequence with two or more selenocysteine residues substituted for two or more cysteine residues
  VARIANT (1)...(451): Xaa = selenocysteine or cysteine
EVQLVESGGGLVQPGGSLRLSXAAAGFTFSSYSMNWVRQAPGKGLEWVSYISSRSRTIYYADSVKGRFTISRDNAKNSLYLQMNSLRDEDTAVYYXARDYGGQPPYYYYYGMDVWGQGTTVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 785 - protein, 448 aa, Artificial Sequence
  Synthesized sequence with two or more selenocysteine residues substituted for two or more cysteine residues
  VARIANT (1)...(448): Xaa = selenocysteine or cysteine
QVQLQQWGAGLLKPSETLSLTXAVYGGSFSGYYWSWIRQSPEKGLEWIGEINHGGYVTYNPSLESRVTISVDTSKNQFSLKLSSVTAADTAVYYXARDYGPGNYDWYFDLWGRGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPPXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 786 - protein, 449 aa, Artificial Sequence
  Synthesized sequence with two or more selenocysteine residues substituted for two or more cysteine residues
  VARIANT (1)...(449): Xaa = selenocysteine or cysteine
EVQLVQSGAEVKKPGESLKISXKGSGYSFTTYWLGWVRQMPGKGLDWIGIMSPVDSDIRYSPSFQGQVTMSVDKSITTAYLQWNSLKASDTAMYYXARRRPGQGYFDFWGQGTLVTVSSSSTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 787 - protein, 442 aa, Artificial Sequence
  Synthesized sequence with two or more selenocysteine residues substituted for two or more cysteine residues
  VARIANT (1)...(442): Xaa = selenocysteine or cysteine
EVQLVQSGAEVKKPGESLRISXKGSGYSFSTYWISWVRQMPGKGLEWMGKIYPGDSYTNYSPSFQGQVTISADKSISTAYLQWSSLKASDTAMYYXARGYGIFDYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPGK

SEQ ID NO: 788 - protein, 447 aa, Artificial Sequence
  Synthesized sequence with two or more selenocysteine residues substituted for two or more cysteine residues
  VARIANT (1)...(447): Xaa = selenocysteine or cysteine
QVQLVQSGAEVKKPGASVKVSXKASGYTFTNYDINWVRQAPGQGLEWIGWIYPGDGSTKYNEKFKAKATLTADTSTSTAYMELRSLRSDDTAVYYXASGYEDAMDYWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPXVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 789 - protein, 454 aa, Artificial Sequence
  Synthesized sequence with two or more selenocysteine residues substituted for two or more cysteine residues
  VARIANT (1)...(454): Xaa = selenocysteine or cysteine
EVQLVESGGGLVQPGGSLRLSXAVSGYSITSDYAWNWVRQAPGKGLEWVGYISNSGSTSYNPSLKSRFTISRDTSKNTLYLQMNSLRAEDTAVYYXARERNYDYDDYYYAMDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 790 - protein, 443 aa, Artificial Sequence
  Synthesized sequence with two or more selenocysteine residues substituted for two or more cysteine residues
  VARIANT (1)...(443): Xaa = selenocysteine or cysteine
EVQLVESGGGLVQPGGSLRLSXAASGFTFSHYTLSWVRQAPGKGLEWVSVISGDGSYTYYADSVKGRFTISSDNSKNTLYLQMNSLRAEDTAVYYXARNFIKYVFANWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPVAGPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPG

SEQ ID NO: 791 - protein, 463 aa, Artificial Sequence
  Synthesized sequence with two or more selenocysteine residues substituted for two or more cysteine residues
  VARIANT (1)...(463): Xaa = selenocysteine or cysteine
QVQLVQSGAEVKKPGASVKVSXKASGYTFTGYYMHWVRQAPGQGLEWMGWINPNSGGTNYAQKFQGRVTMTRDTSISTAYMELSRLRSDDTAVYYXARSPNPYYYDSSGYYYPGAFDIWGQGTMVTVSSASVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVXTLPPSRDELTKNQVSLSXAVKGFYPSDIAVEWESNGQPENNYKTTPPVLDSDGSFFLVSKLTVDKSRWQQGNVFSXSVMHEALHNHYTQKSLSLSPGK

SEQ ID NO: 792 - protein, 452 aa, Artificial Sequence
  Synthesized sequence with two or more selenocysteine residues substituted for two or more cysteine residues
  VARIANT (1)...(452): Xaa = selenocysteine or cysteine
QVQLVESGGGVVQPGRSLRLSXAASGFTFSSYDMHWVRQAPGKGLEWVAVIWYDGSNKYYADSVKGRFTISRDNSKNTLYLQMNSLRAEDTAVYYXARGSGNWGFFDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGKGSS

SEQ ID NO: 793 - protein, 446 aa, Artificial Sequence
  Synthesized sequence with two or more selenocysteine residues substituted for two or more cysteine residues
  VARIANT (1)...(446): Xaa = selenocysteine or cysteine
QVQLQESGPGLVKPSETLSLTXTVSGFSLTNYGIHWIRQPPGKGLEWLGVIWARGFTNYNSALMSRLTISKDNSKNQVSLKLSSVTAADTAVYYXARANDGVYYAMDYWGQGTLVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 794 - protein, 451 aa, Artificial Sequence
  Synthesized sequence with two or more selenocysteine residues substituted for two or more cysteine residues
  VARIANT (1)...(451): Xaa = selenocysteine or cysteine
QVQLVQSGAEVKKPGASVKVSXKGSGYTFTSYWMHWVRQAPGQRLEWIGEIDPSESNTNYNQKFKGRVTLTVDISASTAYMELSSLRSEDTAVYYXARGGYDGWDYAIDYWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELAGAPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 795 - protein, 451 aa, Artificial Sequence
  Synthesized sequence with two or more selenocysteine residues substituted for two or more cysteine residues
  VARIANT (1)...(451): Xaa = selenocysteine or cysteine
QVQLQQSGAEVKKPGSSVKVSXKASGYTFTSYNMHWVKQAPGQGLEWIGAIYPGMGDTSYNQKFKGKATLTADESTNTAYMELSSLRSEDTAFYYXARSTYYGGDWYFDVWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 796 - protein, 453 aa, Artificial Sequence
  Synthesized sequence with two or more selenocysteine residues substituted for two or more cysteine residues
  VARIANT (1)...(453): Xaa = selenocysteine or cysteine
EVQLVESGGGLVQPGGSLRLSXAASGFTFSSYAMSWVRQAPGKGLEWVSQISPAGGYTNYADSVKGRFTISADTSKNTAYLQMNSLRAEDTAVYYXARGELPYYRMSKVMDVWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 797 - protein, 446 aa, Artificial Sequence
  Synthesized sequence with two or more selenocysteine residues substituted for two or more cysteine residues
  VARIANT (1)...(446): Xaa = selenocysteine or cysteine
QVQLVQSGAEVKKPGASVKVSXKASGYTFISYTMHWVRQAPGQGLEWMGYINPRSGYTHYNQKLKDKATLTADKSASTAYMELSSLRSEDTAVYYXARSAYYDYDGFAYWGQGTLVTVSSASTKGPSVFPLAPXSRSTSESTAALGXLVKDYFPEPVTVSWNSGALTSGVHTFPAVLQSSGLYSLSSVVTVPSSNFGTQTYTXNVDHKPSNTKVDKTVERKXXVEXPPXPAPPAAAPSVFLFPPKPKDTLMISRTPEVTXVVVDVSHEDPEVQFNWYVDGVEVHNAKTKPREEQFNSTFRVVSVLTVVHQDWLNGKEYKXKVSNKGLPAPIEKTISKTKGQPREPQVYTLPPSREEMTKNQVSLTXLVKGFYPSDIAVEWESNGQPENNYKTTPPMLDSDGSFFLYSKLTVDKSRWQQGNVFSXSVMHEALHNHYTQKSLSLSPSK

SEQ ID NO: 798 - protein, 451 aa, Artificial Sequence
  Synthesized sequence with two or more selenocysteine residues substituted for two or more cysteine residues
  VARIANT (1)...(451): Xaa = selenocysteine or cysteine
QVQLKESGPGLVAPSQSLSITXTISGFSLTDYGVHWVRQPPGKGLEWLVVIWSDGSSTYNSALKSRMTIRKDNSKSQVFLIMNSLQTDDSAMYYXARHGTYYGMTTTGDALDYWGQGTSVTVSSASTKGPSVFPLAPXSRSTSESTAALGXLVKDYFPEPVTVSWNSGALTSGVHTFPAVLQSSGLYSLSSVVTVPSSSLGTKTYTXNVDHKPSNTKVDKRVESKYGPPXPSXPAPEFLGGPSVFLFPPKPKDTLMISRTPEVTXVVVDVSQEDPEVQFNWYVDGVEVHNAKTKPREEQFNSTYRVVSVLTVLHQDWLNGKEYKXKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLGK

SEQ ID NO: 799 - protein, 448 aa, Artificial Sequence
  Synthesized sequence with two or more selenocysteine residues substituted for two or more cysteine residues
  VARIANT (1)...(448): Xaa = selenocysteine or cysteine
QVQLVQSGAEVKKPGASVKVSXKASGYTFTNYGMNWVRQAPGQGLKWMGWINTYTGEPTYADAFKGRVTMTRDTSISTAYMELSRLRSDDTAVYYXARDYGDYGMDYWGQGTTVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 800 - protein, 447 aa, Artificial Sequence
  Synthesized sequence with two or more selenocysteine residues substituted for two or more cysteine residues
  VARIANT (1)...(447): Xaa = selenocysteine or cysteine
QVELVESGGGLVQPGGSLRLSXAASGFTFTSYWMSWVRQAPGKGLELVSSITSYGSFTYYADSVKGRFTISRDNSKNTLYLQMNSLRAEDTAVYYXARNMYTHFDSWGQGTLVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 801 - protein, 448 aa, Artificial Sequence
  Synthesized sequence with two or more selenocysteine residues substituted for two or more cysteine residues
  VARIANT (1)...(448): Xaa = selenocysteine or cysteine
QVQLQQPGAELVEPGGSVKLSXKASGYTFTSHWMHWVKQRPGQGLEWIGEINPSSGRNNYNEKFKSKATLTVDKSSSTAYMQFSSLTSEDSAVYYXVRYYGYDEAMDYWGQGTSVTVSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKRVEPKSXDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 802 - protein, 232 aa, Artificial Sequence
  Synthesized sequence with two or more selenocysteine residues substituted for two or more cysteine residues
  VARIANT (1)...(232): Xaa = selenocysteine or cysteine
MLPSQLIGFLLLWVPASRGEIVLTQSPDFQSVTPKEKVTITXRASQSIGISHWYQQKPDQSPKLLIKYASQSFSGVPSRFSGSGSGTDFTLTINSLEAEDAATYYXHQSRSFPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 803 - protein, 212 aa, Artificial Sequence
  Synthesized sequence with two or more selenocysteine residues substituted for two or more cysteine residues
  VARIANT (1)...(212): Xaa = selenocysteine or cysteine
DIQMTQSPSTLSASVGDRVTITXRASQSISSWLAWYQQKPGKAPKLLIYKASSLESGVPSRFSGSGSGTEFTLTISSLQPDDFATYYXQQYNSYIFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 804 - protein, 236 aa, Artificial Sequence
  Synthesized sequence with two or more selenocysteine residues substituted for two or more cysteine residues
  VARIANT (1)...(236): Xaa = selenocysteine or cysteine
MDMRVPAQLLGLLLLWLPDTRXDIQMTQSPSTLSASIGDRVTITXRASQGISYYLAWYQQKPGKIPKLLIYDTSSLQSGVPSRFSGSRSGTDLSLTISSLQPEDVATYYXQRYDSAPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 805 - protein, 219 aa, Artificial Sequence
  Synthesized sequence with two or more selenocysteine residues substituted for two or more cysteine residues
  VARIANT (1)...(219): Xaa = selenocysteine or cysteine
DVVMTQSPLSLSVTLGQPASISXRSSQSIVHSNGNTYLEWYLQKPGQSPQLLIYKVSNRFSGVPDRFSGSGSGTDFTLKISRVEAEDVGVYYXFQGSHVPLTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 806 - protein, 219 aa, Artificial Sequence
  Synthesized sequence with two or more selenocysteine residues substituted for two or more cysteine residues
  VARIANT (1)...(219): Xaa = selenocysteine or cysteine
DVVMTQTPLTLSVTIGQPASISXKSSQSLLDSDGKTYLNWLLQRPGQSPKRLIYLVSKLDSGVPDRFTGSGSGTDFTLKISRVEAEDLGVYYXWQGTHFPLTFGAGTKLELKRADAAPTVSIFPPSSEQLTSGGASVVXFLNNFYPKDINVKWKIDGSERQNGVLNSWTDQDSKDSTYSMSSTLTLTKDEYERHNSYTXEATHKTSTSPIVKSFNRNEX

SEQ ID NO: 807 - protein, 219 aa, Artificial Sequence
  Synthesized sequence with two or more selenocysteine residues substituted for two or more cysteine residues
  VARIANT (1)...(219): Xaa = selenocysteine or cysteine
DIQMTQSPSSLSASVGDRVTITXRSSQSIVHNDGNTYFEWYQQKPGKAPKLLIYKVSNRFSGVPSRFSGSGSGTHFTLTISSLQPEDFATYYXFQGSYVPLTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 808 - protein, 236 aa, Artificial Sequence
  Synthesized sequence with two or more selenocysteine residues substituted for two or more cysteine residues
  VARIANT (1)...(236): Xaa = selenocysteine or cysteine
MDMRVPAQLLGLLLLWLSGARXDIQMTQSPSSLSASVGDRVTITXQASQDIINYLNWYQQKPGKAPKLLIYSASNLETRVPSRFSGSGSGTDFTFTISSLQPEDIATYYXQQYDNHPLTFGGGTKVEIRRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 809 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPLSLPVTPGEPASISXRSSQSLLLSHGFNYLDWYLQKPGQSPQLLIYLGSSRASGVPDRFSGSGSGTDFTLKISRVEAEDVGLYYXMQPLQIPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 810 - protein, 241 aa, Artificial Sequence
  Synthesized sequence with two or more selenocysteine residues substituted for two or more cysteine residues
  VARIANT (1)...(241): Xaa = selenocysteine or cysteine
MDMRLPAQLLGLLMLWVPGSSGDVLMTQSPLSLPVTLGQPASISXRSSQSIVHSNGNTYLEWYLQRPGQSPKLLIYKVSNRFSGVPDRFSGSGSGTDFTLKISRVEAEDVGVYYXFQGSHVPLTFGAGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 811 - protein, 214 aa, Artificial Sequence
  Synthesized sequence with two or more selenocysteine residues substituted for two or more cysteine residues
  VARIANT (1)...(214): Xaa = selenocysteine or cysteine
DIQLTQSQSFVSTSVGDRVTVTXRASQNVGSSLVWYQQKPGKSPKTLIYSASFLYSGVPSRFSGSGSGTEFTLTISSVQPEDFADYFXQQYNNYPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 812 - protein, 212 aa, Artificial Sequence
  Synthesized sequence with two or more selenocysteine residues substituted for two or more cysteine residues
  VARIANT (1)...(212): Xaa = selenocysteine or cysteine
SYELTQPPSVSVSPGQTARITXSGDNLPKYYAHWYQQKPGQAPVVVIFYDVNRPSGIPERFSGSNSGNTATLTISGTQAMDEADYYXQAWWSSTPVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 813 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSLSPGERATLSXRASQSVSSYLAWYQQKPGQAPRLLIYDASNRATGIPARFSGSGSGTDFTLTISSLEPEDFAVYYXQQRSNWPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 814 - protein, 220 aa, Artificial Sequence
  Synthesized sequence with two or more selenocysteine residues substituted for two or more cysteine residues
  VARIANT (1)...(220): Xaa = selenocysteine or cysteine
QLVLTQSSSASFSLGASAKLTXTLSSQHSTFTIEWYQQQPLKPPKYVMDLKKDGSHSTGDGVPDRFSGSSSGADRYLSISNIQPEDEATYIXGVGDTIKEQFVYVFGGGTKVTVLGQPKSTPTLTVFPPSSEELKENKATLVXLISNFSPSGVTVAWKANGTPITQGVDTSNPTKEGNKFMASSFLHLTSDQWRSHNSFTXQVTHEGDTVEKSLSPAEXL

SEQ ID NO: 815 - protein, 221 aa, Artificial Sequence
  Synthesized sequence with two or more selenocysteine residues substituted for two or more cysteine residues
  VARIANT (1)...(221): Xaa = selenocysteine or cysteine
DIVMTQTPLSSPVTLGQPASISXRSSQSLVHSDGNTYLSWLQQRPGQPPRLLIYKISNRFSGVPDRFSGSGAGTDFTLKISRVEAEDVGVYYXMQATQFPHQWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 816 - protein, 216 aa, Artificial Sequence
  Synthesized sequence with two or more selenocysteine residues substituted for two or more cysteine residues
  VARIANT (1)...(216): Xaa = selenocysteine or cysteine
DIQMTQSPSSLSASVGDRVTITXRASQGIRNDLGWYQQKPGKAPKRLIYAASSLQSGVPSRFSGSGSGTEFTLTISSLQPEDFATYYXLQHNSYPPVYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 817 - protein, 212 aa, Artificial Sequence
  Synthesized sequence with two or more selenocysteine residues substituted for two or more cysteine residues
  VARIANT (1)...(212): Xaa = selenocysteine or cysteine
EIVLTQSPAIMSASPGEKVTMTXSASSSVSYMHWYQQKSGTSPKRWIYDSSRLASGVPSRFSGGGSGTSYSLTISNMEAEDAATYFXQNWRSSPTFGAGTKLELKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 818 - protein, 213 aa, Artificial Sequence
  Synthesized sequence with two or more selenocysteine residues substituted for two or more cysteine residues
  VARIANT (1)...(213): Xaa = selenocysteine or cysteine
SYELTQPPSVSVAPGQTARISXSGDNIGGTFVSWYQQKPGQAPVLVIYDDNDRPSGIPERFSGSNSGNTATLTISGTQAEDEADYYXGTWDMVTNNVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 819 - protein, 234 aa, Artificial Sequence
  Synthesized sequence with two or more selenocysteine residues substituted for two or more cysteine residues
  VARIANT (1)...(234): Xaa = selenocysteine or cysteine
MRLPAQLLGLLLLWFPGSRXDIQMTQSPSSVSASVGDRVTITXRASQGIYSWLAWYQQKPGKAPNLLIYTASTLQSGVPSRFSGSGSGTDFTLTISSLQPEDFATYYXQQANIFPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 820 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSVSASVGDRVTITXRASQGISSWLAWYQQKPGKAPKLLIYAASSLQSGVPSRFSGSGSGTDFTLTISSLQPEDFATYYXQQANSFPITFGQGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 821 - protein, 215 aa, Artificial Sequence
  Synthesized sequence with two or more selenocysteine residues substituted for two or more cysteine residues
  VARIANT (1)...(215): Xaa = selenocysteine or cysteine
DIVLTQSPATLSLSPGERATLSXRASQYGSSSYLAWYQQKPGQAPRLLIYDASNRATGVPARFSGSGSGTDFTLTISSLEPEDFAVYYXQQYSDWPFTFGQGTKVEIKRTVAAPSVFIFPPSNEQLKSGTASVVXLLNNFYPREAKVQWKVDNALQSGNSQESVTEQDSKDSTYSLSSYLTLSKADYEKHKVYAXEVTHQGLSSPVTKSFDRGEX

SEQ ID NO: 822 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXSASQGISNYLNWYQQKPGKVPKLLIYYTSSLHSGVPSRFSGSGSGTDFTLTISSLQPEDVATYYXQQYLAFPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 823 - protein, 215 aa, Artificial Sequence
  Synthesized sequence with two or more selenocysteine residues substituted for two or more cysteine residues
  VARIANT (1)...(215): Xaa = selenocysteine or cysteine
DIQMTQSPASLSASVGETVTITXRASGNIHNYLAWYQQKQGKSPQLLVYNAKTLADGVPSRFSGSESGTQYSLKINSLQPEDFGSYYXQHFWSTPFTFGSGTKLELKRGTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 824 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASQDIKSFLSWYQQKPEKAPKSLIYYATSLADGVPSRFSGSGSGTDYTLTISSLQPEDFATYYXLQHGESPYTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 825 - protein, 220 aa, Artificial Sequence
  Synthesized sequence with two or more selenocysteine residues substituted for two or more cysteine residues
  VARIANT (1)...(220): Xaa = selenocysteine or cysteine
DVVMTQTPLSLPVTPGEPASISXRSSQSLVHRNGNTYLHWYLQKPGQSPKLLIHKVSNRFSGVPDRFSGSGSGTDFTLKISRVEAEDLGVYFXSQSTHVPPLTFGAGTKLELKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 826 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPLSLPVTPGEPASISXRSSQNIVHINGNTYLEWYLQKPGQSPRLLIYKISDRFSGVPDRFSGSGSGTDFTLKISRVEADDVGVYYXFQGSHVPWTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 827 - protein, 217 aa, Artificial Sequence
  Synthesized sequence with two or more selenocysteine residues substituted for two or more cysteine residues
  VARIANT (1)...(217): Xaa = selenocysteine or cysteine
DIVLTQSPASLAVSLGQRATISXKASQSVDYDGDNYMNWYQQTSGQPPKFLISGASNLESGIPARFSGSGSGTDFTLNIHPVEEEDAATYYXQQSNEDPWTFGGGTKLEIKRVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 828 - protein, 219 aa, Artificial Sequence
  Synthesized sequence with two or more selenocysteine residues substituted for two or more cysteine residues
  VARIANT (1)...(219): Xaa = selenocysteine or cysteine
DIQMTQSPSSLSASVGDRVTITXRSSQSIVHSNGNTYLEWYQQKPGKAPKLLIYKVSNRFSGVPSRFSGSGSGTDFTLTISSLQPEDFATYYXFQGSHIPYTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 829 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPGTLSLSLGERATLSXRASQSISSSFLAWYQQKPGQAPKLLIYAASTRATGIPDRFSGSGSGTDFTLTISRLEPEDFAVYYXQQYGRSLSFGGGTKVEVKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 830 - protein, 219 aa, Artificial Sequence
  Synthesized sequence with two or more selenocysteine residues substituted for two or more cysteine residues
  VARIANT (1)...(219): Xaa = selenocysteine or cysteine
DVVMTQSPLSLPVTPGEPASISXRSSQSLLHSNGNNYLDWYLQKPGQSPQLLIYLGSNRASGVPDRFSGSGSDTDFTLQISRVEAEDVGVYYXMQGTHPAISFGQGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 831 - protein, 213 aa, Artificial Sequence
  Synthesized sequence with two or more selenocysteine residues substituted for two or more cysteine residues
  VARIANT (1)...(213): Xaa = selenocysteine or cysteine
DIQLTQSPSSLSASVGDRVTITXKASQDVGTSVAWYQQKPGKAPKLLIYWTSTRHTGVPSRFSGSGSGTDFTFTISSLQPEDIATYYXQQYSLYRSFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 832 - protein, 214 aa, Artificial Sequence
  Synthesized sequence with two or more selenocysteine residues substituted for two or more cysteine residues
  VARIANT (1)...(214): Xaa = selenocysteine or cysteine
AIRMTQSPSSFSASTGDRVTITXRASQDIRNYVAWYQQKSGKAPKFLIYAASTLQSGVPSRFSGSGSGTDFTLTINSLQSEDFATYYXQQYYNSPPTFGQGTRVEITRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 833 - protein, 215 aa, Artificial Sequence
  Synthesized sequence with two or more selenocysteine residues substituted for two or more cysteine residues
  VARIANT (1)...(215): Xaa = selenocysteine or cysteine
DIQMTQSPSSLSASVGDRVTITXSASSRVSSTYLFWYQQKPGKAPKLLIYRTSPLASGVPSRFSGSGSGTDFTLTISSLQPEDFATYYXQQWSGYPFVFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 834 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASKSISKYTAWYQQKPGKAPKLLIYAGSKLHWGVPSRFSGSGSGTDFTLTISSLQPEDFATYYXQQHNEYPYTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 835 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPLSLPVTPGEPASISXRSSKSLLHRNGITYSYWYLQKPGQSPQLLIYQLSNLASGVPDRFSGSGSGTDFTLKISRVEAEDVGVYYXYQNLELPLTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 836 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSLSPGERATLSXRASQSVRSYLAWYQQKPGQAPRLLIYDASNRATGIPARFSGSGSGTDFTLTISSLEPEDFAVYYXQQRSNWPPTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 837 - protein, 214 aa, Artificial Sequence
  Synthesized sequence with two or more selenocysteine residues substituted for two or more cysteine residues
  VARIANT (1)...(214): Xaa = selenocysteine or cysteine
QSVLTQPPSLSVAPGKTATFTXGGNNIGDKSVHWYRQKPGQAPVLVMYLDTERPSGIPERMSGSNFGNTATLTITRVEAEDEADYYXQVWDSGSDHVVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPAEXS

SEQ ID NO: 838 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSVSASVGDRVTITXKASQDVYIAVAWYQQKPGKAPKLLIYWASTRDTGVPSRFSGSGSGTDFTLTISSLQPEDFATYYXHQYSSYPPTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 839 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSSLSASVGDRVTITXRASQDISNYLNWYQQKPGKAPKLLIYYTSRLHSGVPSRFSGSGSGTDFTLTISSLQPEDFATYYXQQFHTLRTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 840 - protein, 236 aa, Artificial Sequence
  Synthesized sequence with two or more selenocysteine residues substituted for two or more cysteine residues
  VARIANT (1)...(236): Xaa = selenocysteine or cysteine
MDMRVPAQLLGLLLLWFPGSRXDIQMTQSPSSVSASVGDRVTITXRASQGISSWLAWYQQKPGKAPKLLIYEASNLETGVPSRFSGSGSGSDFTLTISSLQPEDFATYYXQQTSSFLLSFGGGTKVEHKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 841 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSTLSASVGDRVTITXRASQGISSWLAWYQQKPGKAPKVLIYKASTLESGVPSRFSGSGSGTEFTLTISSLQPDDFATYYXQQSWLGGSFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 842 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPATLSLSPGERATLSXRSSKSLQNVNGNTYLYWFQQKPGQSPQLLIYRMSNLNSGVPDRFSGSGSGTEFTLTISSLEPEDFAVYYXMQHLEYPITFGAGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 843 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPVTLSVSPGERVTLSXRASQSVSTNLAWYQQKLGQGPRLLIYGASTRATDIPARFSGSGSETEFTLTISSLQSEDFAVYYXQQYDKWPDTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 844 - protein, 238 aa, Artificial Sequence
  Synthesized sequence with two or more selenocysteine residues substituted for two or more cysteine residues
  VARIANT (1)...(238): Xaa = selenocysteine or cysteine
MEKDTLLLWVLLLWVPGSTGDIVLTQSPASLAVSLGQRATISXRASESVDNYGISYMNWFQQKPGQPPKVLIYAASNQGSGVPARFSGSGSGTDFSLNIHPMEEDDTAMYFXQQSKEVPWTFGGGTKLEIKRTVAAPSVFIFPPSDEQLKSGTASVVXLLNNFYPREAKVQWKVAAALQSGNSQESVTEQDSKDSTYSLSSTLTLSKADYEKHKVYAXEVTHQGLSSPVTKSFNRGEX

SEQ ID NO: 845 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQGISSWLAWYQQKPEKAPKSLIYAASSLQSGVPSRFSGSGSGTDFTLTISSLQPEDFATYYXQQYKSYPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 846 - protein, 219 aa, Artificial Sequence
  Synthesized sequence with two or more selenocysteine residues substituted for two or more cysteine residues
  VARIANT (1)...(219): Xaa = selenocysteine or cysteine
DVVMTQTPLSLPVTPGQPASISXRSSQSILHSNGNTYLEWYLQKPGQSPQLLIYKVSNRFSGVPDRFSGSGSGTDFTLKISRVEAEDVGVYYXLQTTRVPLTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 847 - protein, 217 aa, Artificial Sequence
  Synthesized sequence with two or more selenocysteine residues substituted for two or more cysteine residues
  VARIANT (1)...(217): Xaa = selenocysteine or cysteine
QSVLTQPPSVSGAPGQRVTISXTGSSSNIGAGYDVHWYQQLPGTAPKLLIYGYSNRPSGVPDRFSGSKSGASASLAITGLRPDDEADYYXQSYDNSLSSYVFGGGTQLTVLSQPKANPTVTLFPPSSEELQANKATLVXLISDFYPGAVTVAWKADGSPVKAGVETTKPSKQSNNKYAASSYLSLTPEQWKSHRSYSXQVTHEGSTVEKTVAPTEXS

SEQ ID NO: 848 - protein, 238 aa, Artificial Sequence
  Synthesized sequence with two or more selenocysteine residues substituted for two or more cysteine residues
  VARIANT (1)...(238): Xaa = selenocysteine or cysteine
METDTILLWVLLLWVPGSTGDIVLTQSPASLAVSLGQRATISXKASQSVDYDGGSYMSWFQQRPGQPPKLLISAASNLESGIPARFSGSGSGTDFTLNIHPVEEEDVATYYXQQSYEDPLTFGAGTKLELKRADAAPTVSIFPPSSEQLTSGGASVVXFLNNFYPKDINVKWKIDGSERQNGVLNSWTDQDSKDSTYSMSSTLTLTKDEYERHNSYTXEATHKTSTSPIVKSFNRNEX

SEQ ID NO: 849 - protein, 234 aa, Artificial Sequence
  Synthesized sequence with two or more selenocysteine residues substituted for two or more cysteine residues
  VARIANT (1)...(234): Xaa = selenocysteine or cysteine
METPAQLLFLLLLWLPDTTGEIVMTQSPATLSVSPGERATLSXRASQSVRSNLAWYQQKPGQAPRLLIYGASTRATGIPARFSGSGSGTEFTLTISSLQSEDFAVYSXQQYNNWPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 850 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSSLSASVGDRVTITXKASQDVSTAVAWYQQKPGQAPRLLIYWASTRHTGVPSRFSGSGSGTDFTLTISSLQPEDFALYYXQQHYSTPWTFGQGTKLEIKRTVAAPSVFIFPPSDEQLKSGTASWXLLNNFYPREAKVQWKVDNALQSGNSQESVTEQDSKDSTYSLSSTLTLSKADYEKHKVYAXEVTHQGLSSPVTKSFNRGEX

SEQ ID NO: 851 - protein, 217 aa, Artificial Sequence
  Synthesized sequence with two or more selenocysteine residues substituted for two or more cysteine residues
  VARIANT (1)...(217): Xaa = selenocysteine or cysteine
DIVLTQSPATLSLSPGERATLSXRASESVEYYGTSLMQWYQQKPGQPPKLLIFGASNVESGVPDRFSGSGSGTDFTLKISRVEAEDVGMYFXQQSRKLPWTFGGGTKVEIKRTVAAPSVFIFPPSDEQLKSGTASWXLLNNFYPREAKVQWKVDNALQSGNSQESVTEQDSKDSTYSLSSTLTLSKADYEKHKVYAXEVTHQGLSSPVTKSFNRGEX

SEQ ID NO: 852 - protein, 215 aa, Artificial Sequence
  Synthesized sequence with two or more selenocysteine residues substituted for two or more cysteine residues
  VARIANT (1)...(215): Xaa = selenocysteine or cysteine
DIQMTQSPSSLSASVGDRVTITXKASQDVSTAVAWYQQKPGKAPKLLIYSASYRYTGVPDRFTGSGSGTDFTLTISSLQPEDFATYYXQQHYSTPPYTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 853 - protein, 239 aa, Artificial Sequence
  Synthesized sequence with two or more selenocysteine residues substituted for two or more cysteine residues
  VARIANT (1)...(239): Xaa = selenocysteine or cysteine
MRLPAQLLGLLMLWIPGSSADIVMTQTPLSLSVTPGQPASISXKSSQSLLHTDGTTYLYWYLQKPGQPPQLLIYEVSNRFSGVPDRFSGSGSGTDFTLKISRVEAEDVGIYYXMQNIQLPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 854 - protein, 215 aa, Artificial Sequence
  Synthesized sequence with two or more selenocysteine residues substituted for two or more cysteine residues
  VARIANT (1)...(215): Xaa = selenocysteine or cysteine
NFMLTQPHSVSESPGKTVTISXTRSSGSIDSSYVQWYQQRPGSSPTTVIYEDDQRPSGVPDRFSGSIDSSSNSASLTISGLKTEDEADYYXQSYDFHHLVFGGGTKLTVLQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 855 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASEDIYNALAWYQQKPGKAPKLLIYNTDTLHTGVPSRFSGSGSGTDYTLTISSLQPEDFATYFXQHYFHYPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 856 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQDVSTAVAWYQQKPGKAPKLLIYSASFLYSGVPSRFSGSGSGTDFTLTISSLQPEDFATYYXQQAYPALHTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 857 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSSLSASVGDRVTITXRTSENVYSNLAWYQQKPGKAPKLLIYAASNLQSGVPSRFSGSGSGTDYTFTISSLQPEDIATYYXQHFWGSPFTFGQGTKLEIKTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 858 - protein, 238 aa, Artificial Sequence
  Synthesized sequence with two or more selenocysteine residues substituted for two or more cysteine residues
  VARIANT (1)...(238): Xaa = selenocysteine or cysteine
MGWSXIILFLVATATGVHSDVVMTQTPLSLSVTLGQPASISXKSSQSLIHSDGRTYLNWLLQRPGQSPKRLIYLVSRLDSGVPDRFTGSGAGTDFTLKISRVEAEDLGVYYXWQGSHFPRTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 859 - protein, 212 aa, Artificial Sequence
  Synthesized sequence with two or more selenocysteine residues substituted for two or more cysteine residues
  VARIANT (1)...(212): Xaa = selenocysteine or cysteine
DIQLTQSPAIMSASPGEKVTMTXSASSSVSYIHWYQQKSGTSPKRWVYDTSKLASGVPARFSGSGSGTSYSLTISTMEAEDAATYYXQQWNNNPYSFGGGTKVVIKTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 860 - protein, 234 aa, Artificial Sequence
  Synthesized sequence with two or more selenocysteine residues substituted for two or more cysteine residues
  VARIANT (1)...(234): Xaa = selenocysteine or cysteine
MEAPAQLLFLLLLWLPDTHGDIVMTQSPSSLSASVGDRVTITXKASENVVTYVSWYQQKPGKAPKLLIYGASNRYTGVPDRFSGSGSGTDFTLTISSLQPEDFATYYXGQGYSYPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 861 - protein, 237 aa, Artificial Sequence
  Synthesized sequence with two or more selenocysteine residues substituted for two or more cysteine residues
  VARIANT (1)...(237): Xaa = selenocysteine or cysteine
METDTILLWVLLLWVPGSTGDIVMTQSPDSLAVSLGERATINXKASQSVDYDGDSYMNWYQQKPGQPPKLLIYVASNLESGVPQRFSGSGSGTDFTLTISSLQAEDVAVYYXQQSLQDPPTFGGGTKVEIKRTVAALSVFIFPPSDEQLKSGTASVVXLLNNFYPREAKVQWKVDNALQSGNSQESVTEQDSKDSTSLSSTLTLSKADYEKHKVYAXEVTHQGLSSPVTKSFNRGEX

SEQ ID NO: 862 - protein, 217 aa, Artificial Sequence
  Synthesized sequence with two or more selenocysteine residues substituted for two or more cysteine residues
  VARIANT (1)...(217): Xaa = selenocysteine or cysteine
QSVLTQPPSASGTPGQRVTISXSGSNSNIGSNTVNWYQQLPGTAPKLLIYSDSNRPSGVPDRFSGSKSGTSASLAISGLRSEDEADYYXQSYDSSLSGSRVFGGGTKLTVLGQPKANPTVTLFPPSSEELQANKATLVXLISDFYPGAVTVAWKADGSPVKAGVETTKPSKQSNNKYAASSYLSLTPEQWKSHRSYSXQVTHEGSTVEKTVAPTEXS

SEQ ID NO: 863 - protein, 237 aa, Artificial Sequence
  Synthesized sequence with two or more selenocysteine residues substituted for two or more cysteine residues
  VARIANT (1)...(237): Xaa = selenocysteine or cysteine
METDTILLWVLLLWVGSTGDIVLTQSPVSLAVSLGQRATISXKASQSVDYDGDSYMNWYQQKPGQPPKLLIYVASNLESGIPARFSGSGSGTDFTLNIHPVEEEDVATYYXQQSNEDPWTFGGGTKLEMKRADAAPTVSIFPPSSEQLTSGGASVVXFLNNFYPKDINVKWKIDGSERQNGVLNSWTDQDSKDSTYSMSSTLTLTKDEYERHNSYTXEATHKTSTSPIVKSFNRNEX

SEQ ID NO: 864 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASIGDRVTISXRASQAINNYVAWFQQSAGKAPKSLIYGASNLQPGVPPRFSGSVSGTNFSLTIDGLQSEDFATYFXQNYFGYPLTFGGGTTLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 865 - protein, 217 aa, Artificial Sequence
  Synthesized sequence with two or more selenocysteine residues substituted for two or more cysteine residues
  VARIANT (1)...(217): Xaa = selenocysteine or cysteine
QSALTQPASASGSPGQSVTITXTGSSSDVGGYKYVSWYQHHPGKAPKLMIYEVSKRPSGVPDRFSGSKSGNMASLTVSGLQAEDEADYYXSSYAGSYNFYVFGNGTKVTVLGQPKANPTVTLFPPSSEELQANKATLVXLISDFYPGAVTVAWKADGSPVKAGVETTKPSKQSNNKYAASSYLSLTPEQWKSHRSYSXQVTHEGSTVEKTVAPTEXS

SEQ ID NO: 866 - protein, 215 aa, Artificial Sequence
  Synthesized sequence with two or more selenocysteine residues substituted for two or more cysteine residues
  VARIANT (1)...(215): Xaa = selenocysteine or cysteine
DIVLTQSPATLSLSPGERATLSXRASQFISSSYLSWYQQKPGQAPRLLIYGSSSRATGVPARFSGSGSGTDFTLTISSLEPEDFAVYYXQQLYSSPMTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 867 - protein, 217 aa, Artificial Sequence
  Synthesized sequence with two or more selenocysteine residues substituted for two or more cysteine residues
  VARIANT (1)...(217): Xaa = selenocysteine or cysteine
SYELTQPPSSSGTPGQRVTISXSGSSSNIGRHTVSWYQQVPGTAPKLLIYSDDHRPSGVPDRFSASKSGTSASLTITGLQSEDEADYYXAAWDDSLNGPWVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 868 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASQSVSNDVAWYQQKPGKAPKLLIYFATNRYTGVPSRFSGSGYGTDFTLTISSLQPEDFATYYXQQDYSSPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 869 - protein, 214 aa, Artificial Sequence
  Synthesized sequence with two or more selenocysteine residues substituted for two or more cysteine residues
  VARIANT (1)...(214): Xaa = selenocysteine or cysteine
DIELTQSPASLSASVGETVTITXQASENIYSYLAWHQQKQGKSPQLLVYNAKTLAGGVSSRFSGSGSGTHFSLKIKSLQPEDFGIYYXQHHYGILPTFGGGTKLEIKRADAAPTVSIFPPSSEQLTSGGASVVXFLNNFYPKDINVKWKIDGSERQNGVLNSWTDQDSKDSTYSMSSTLTLTKDEYERHNSYTXEATHKTSTSPIVKSFNRNEX

SEQ ID NO: 870 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSSLSASVGDRVTITXRASQDISNYIAWYQQKPGKAPKLLIYYTSKIHSGVPSRFSGSGSGTDYTFTISSLQPEDIATYYXQQGNTFPYTFGQGTKVEIKRTVAAPSVFIFPPSDEQLKSGTASWXLLNNFYPREAKVQWKVDNALQSGNSQESVTEQDSKDSTYSLSSTLTLSKADYEKHKVYAXEVTHQGLSSPVTKSFNRGEX

SEQ ID NO: 871 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSVSASVGDRVTITXRASQGISSWLAWYQQKPGKAPKLLIYGASNLESGVPSRFSGSGSGTDFTLTISSLQPEDFANYYXQQANSFPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 872 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPGTLSLSPGERATLSXRASQSVSSSYLAWYQQKPGQAPRLLIYGASSRATGIPDRFSGSGSGTDFTLTISRLEPEDFAVYYXQQYGSSTWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 873 - protein, 214 aa, Artificial Sequence
  Synthesized sequence with two or more selenocysteine residues substituted for two or more cysteine residues
  VARIANT (1)...(214): Xaa = selenocysteine or cysteine
ELQMTQSPSSLSASVGDRVTITXRTSQSISSYLNWYQQKPGQPPKLLIYWASTRESGVPDRFSGSGSGTDFTLTISSLQPEDSATYYXQQSYDIPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 874 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQSISSYLNWYQQKPGKAPKLLIYAASSLQSGVPSRFSGSGSGTDFTLTISSLQPEDFATYYXQQSYSTPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 875 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPATLSLSPGERATLSXRASQSVRSYLAWYQQKPGQAPRLLIYDASNRATGIPARFSGSGSGTDFTLTISSLEPEDFAVYYXQQRSNWPPATFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 876 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQDIAGSLNWLQQKPGKAIKRLIYATSSLDSGVPKRFSGSRSGSDYTLTISSLQPEDFATYYXLQYGSFPPTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 877 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASQNIDKYLNWYQQKPGKAPKLLIYNTNNLQTGVPSRFSGSGSGTDFTFTISSLQPEDIATYYXLQHISRPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 878 - protein, 220 aa, Artificial Sequence
  Synthesized sequence with two or more selenocysteine residues substituted for two or more cysteine residues
  VARIANT (1)...(220): Xaa = selenocysteine or cysteine
DIVMTQSPDSLAVSLGERATINXKSSQSVLYRSNNRNFLGWYQQKPGQPPNLLIYWASTRESGVPDRFSGSGSGTDFTLTISSLQAEDVAVYYXQQYYTTPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 879 - protein, 213 aa, Artificial Sequence
  Synthesized sequence with two or more selenocysteine residues substituted for two or more cysteine residues
  VARIANT (1)...(213): Xaa = selenocysteine or cysteine
DIELTQSPAIMSASPGEKVTMTXSASSSVSYMHWYQQKSGTSPKRWIYDTSKLASGVPGRFSGSGSGNSYSLTISSVEAEDDATYYXQQWSKHPLTFGSGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 880 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASQDVRNTVAWYQQKPGKAPKLLIYSSSYRNTGVPDRFSGSGSGTDFTLTISSLQAEDVAVYYXQQHYITPYTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 881 - protein, 217 aa, Artificial Sequence
  Synthesized sequence with two or more selenocysteine residues substituted for two or more cysteine residues
  VARIANT (1)...(217): Xaa = selenocysteine or cysteine
DIALTQPASVSGSPGQSITISXTGTSSDIGGYNSVSWYQQHPGKAPKLMIYGVNNRPSGVSNRFSGSKSGNTASLTISGLQAEDEADYYXSSYDIESATPVFGGGTKLTVLGQPKAAPSVTLFPPSSEELQANKATLVXLISDFYPGAVTVAWKGDSSPVKAGVETTTPSKQSNNKYAASSYLSLTPEQWKSHRSYSXQVTHEGSTVEKTVAPTEXS

SEQ ID NO: 882 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPGTLSLSPGERATLSXRASQSVSSSFFAWYQQKPGQAPRLLIYGASSRATGIPDRLSGSGSGTDFTLTITRLEPEDFAVYYXQQYDSSAITFGQGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 883 - protein, 218 aa, Artificial Sequence
  Synthesized sequence with two or more selenocysteine residues substituted for two or more cysteine residues
  VARIANT (1)...(218): Xaa = selenocysteine or cysteine
DIQMTQSPSSLSASVGDRVTITXKASESVDNYGKSLMHWYQQKPGKAPKLLIYRASNLESGVPSRFSGSGSGTDFTLTISSLQPEDFATYYXQQSNEDPWTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 884 - protein, 216 aa, Artificial Sequence
  Synthesized sequence with two or more selenocysteine residues substituted for two or more cysteine residues
  VARIANT (1)...(216): Xaa = selenocysteine or cysteine
QSVLTQPPSASGTPGQRVTISXSGSSSNIGNNYVSWYQQLPGTAPKLLIYENYNRPAGVPDRFSGSKSGTSASLAISGLRSEDEADYYXSSWDDSLNYWVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 885 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPGTLSLSPGERATLSXRASQSVSSSYLAWYQQKPGQAPRLLIYGTSSRATGIPDRFSGSGSGTDFTLTISRLEPEDFAVYYXQQYGSSPITFGQGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 886 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQDVSTAVAWYQQKPGKAPKLLIYSASFLYSGVPSRFSGSGSGTDFTLTISSLQPEDFATYYXQQYLYHPATFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 887 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSLSPGERATLSXRASQSVSSYLAWYQQKPGQAPRLLIYDASNRATGIPARFSGSGSGTDFTLTISSLEPEDFAVYYXQQRSNWPITFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 888 - protein, 216 aa, Artificial Sequence
  Synthesized sequence with two or more selenocysteine residues substituted for two or more cysteine residues
  VARIANT (1)...(216): Xaa = selenocysteine or cysteine
QSALTQPASVSGSPGQSITISXTGTSSDVGGYNYVSWYQQHPGKAPKLMIYDVSNRPSGVSNRFSGSKSGNTASLTISGLQAEDEADYYXSSYTSSSTRVFGTGTKVTVLGQPKANPTVTLFPPSSEELQANKATLVXLISDFYPGAVTVAWKADGSPVKAGVETTKPSKQSNNKYAASSYLSLTPEQWKSHRSYSXQVTHEGSTVEKTVAPTEXS

SEQ ID NO: 889 - protein, 241 aa, Artificial Sequence
  Synthesized sequence with two or more selenocysteine residues substituted for two or more cysteine residues
  VARIANT (1)...(241): Xaa = selenocysteine or cysteine
MDMRVPAQLLGLLMLWVSGSSGDVVMTQSPLSLPVTPGEPASISXKSSQSLLDSDGKTYLNWLLQKPGQSPQRLIYLVSKLDSGVPDRFSGSGSGTDFTLKISRVEAEDVGVYYXWQGTHFPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 890 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASLGERVSLTXRASQDIGSSLNWLQQGPDGTIKRLIYATSSLDSGVPKRFSGSRSGSDYSLTISSLESEDFVDYYXLQYVSSPPTFGAGTKLELKRADAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 891 - protein, 213 aa, Artificial Sequence
  Synthesized sequence with two or more selenocysteine residues substituted for two or more cysteine residues
  VARIANT (1)...(213): Xaa = selenocysteine or cysteine
QIVLTQSPAIMSASPGEKVTITXSASSSVSYMNWFQQKPGTSPKLWIYSTSNLASGVPARFSGSGSGTSYSLTISRMEAEDAATYYXQQRSSYPNTFGGGTKLEIKRADAAPTVSIFPPSSEQLTSGGASVVXFLNNFYPKDINVKWKIDGSERQNGVLNSWTDQDSKDSTYSMSSTLTLTKDEYERHNSYTXEATHKTSTSPIVKSFNRNEX

SEQ ID NO: 892 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXGTSEDIINYLNWYQQKPGKAPKLLIYHTSRLQSGVPSRFSGSGSGTDFTLTISSLQPEDFATYYXQQGYTLPYTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 893 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXSASQDISNYLNWYQQKPGKAPKVLIYFTSSLHSGVPSRFSGSGSGTDFTLTISSLQPEDFATYYXQQYSTVPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 894 - protein, 215 aa, Artificial Sequence; identical to SEQ ID NO: 872
  Synthesized sequence with two or more selenocysteine residues substituted for two or more cysteine residues
  VARIANT (1)...(215): Xaa = selenocysteine or cysteine

SEQ ID NO: 895 - protein, 217 aa, Artificial Sequence
  Synthesized sequence with two or more selenocysteine residues substituted for two or more cysteine residues
  VARIANT (1)...(217): Xaa = selenocysteine or cysteine
QSALTQPASVSGSPGQSITISXTGTSSDVGSYNYVNWYQQHPGKAPKLMIYGVSKRPSGVSNRFSGSKSGNTASLTISGLQAEDEADYYXGTFAGGSYYGVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 896 - protein, 214 aa, Artificial Sequence
  Synthesized sequence with two or more selenocysteine residues substituted for two or more cysteine residues
  VARIANT (1)...(214): Xaa = selenocysteine or cysteine
AIQLTQSPSSLSASVGDRVTITXRADESVTTLMHWYQQKPGKAPKLLIYLVSNRESGVPSRFSGSGSGTDFTLTISSLQPEDFATYYXQQTWSDPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 897 - protein, 213 aa, Artificial Sequence
  Synthesized sequence with two or more selenocysteine residues substituted for two or more cysteine residues
  VARIANT (1)...(213): Xaa = selenocysteine or cysteine
EIVLTQSPATLSLSPGERATLSXSASSSINYIYWYQQKPGQAPRLLIYLTSNLASGVPARFSGSGSGTDFTLTISSLEPEDFAVYYXLQWSSNPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 898 - protein, 213 aa, Artificial Sequence
  Synthesized sequence with two or more selenocysteine residues substituted for two or more cysteine residues
  VARIANT (1)...(213): Xaa = selenocysteine or cysteine
AIQLTQSPSSLSASVGDRVTITXRASQGISSALAWYQQKPGKAPKLLIYDASNLESGVPSRFSGSGSGTDFTLTISSLQPEDFATYYXQQFNSYPTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 899 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASQDVHTAVAWYQQKPGKAPKLLIYWASTRWTGVPSRFSGSGSGTDFTLTISSLQPEDFATYYXQQYSDYPWTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 900 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQGISSALAWYQQKPGKAPKLLIYSASYRYTGVPSRFSGSGSGTDFTFTISSLQPEDIATYYXQQRYSLWRTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 901 - protein, 217 aa, Artificial Sequence
  Synthesized sequence with two or more selenocysteine residues substituted for two or more cysteine residues
  VARIANT (1)...(217): Xaa = selenocysteine or cysteine
QSVLTQPPSVSGAPGQRVTISXTGSSSNTGAGYDVHWYQQVPGTAPKLLIYGSGNRPSGVPDRFSGSKSGTSASLAITGLQAEDEADYYXQSYDSSLSGWVFGGGTRLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 902 - protein, 218 aa, Artificial Sequence
  Synthesized sequence with two or more selenocysteine residues substituted for two or more cysteine residues
  VARIANT (1)...(218): Xaa = selenocysteine or cysteine
DIVLTQSPASLAVSLGQRATISXKASQSVDFDGDSYMNWYQQKPGQPPKVLIYAASNLESGIPARFSGSGSGTDFTLNIHPVEEEDAATYYXQQSNEDPWTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 903 - protein, 217 aa, Artificial Sequence
  Synthesized sequence with two or more selenocysteine residues substituted for two or more cysteine residues
  VARIANT (1)...(217): Xaa = selenocysteine or cysteine
QSVLTQPPSVSGAPGQRVTISXSGSRSNIGSNTVKWYQQLPGTAPKLLIYYNDQRPSGVPDRFSGSKSGTSASLAITGLQAEDEADYYXQSYDRYTHPALLFGTGTKVTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 904 - protein, 214 aa, Artificial Sequence
  Synthesized sequence with two or more selenocysteine residues substituted for two or more cysteine residues
  VARIANT (1)...(214): Xaa = selenocysteine or cysteine
EIVMTQSPATLSVSPGERATLSXRASQSVSSNLAWFQQKPGQAPRPLIYDASTRATGVPARFSGSGSGTDFTLTISSLQSEDFAVYYXQQYDNWPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 905 - protein, 213 aa, Artificial Sequence
  Synthesized sequence with two or more selenocysteine residues substituted for two or more cysteine residues
  VARIANT (1)...(213): Xaa = selenocysteine or cysteine
AIQLTQSPSSLSASVGDRVTITXRASQGISSALVWYQQKPGKAPKLLIYDASSLESGVPSRFSGSGSGTDFTLTISSLQPEDFATYYXQQFNDYFTFGPGTKVDIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 906 - protein, 218 aa, Artificial Sequence
  Synthesized sequence with two or more selenocysteine residues substituted for two or more cysteine residues
  VARIANT (1)...(218): Xaa = selenocysteine or cysteine
EIVLTQSPATLSLSPGERATLSXKASQSVDYDGDNYMNWYQQKPGQAPRLLIYAASNLESGIPARFSGSGSGTDFTLTISSLEPEDFAVYYXHLSNEDLSTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 907 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXLASQTIGTWLTWYQQKPGKAPKLLIYTATSLADGVPSRFSGSGSGTDFTLTISSLQPEDFATYYXQQVYSIPWTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 908 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPLSVPVTPGEPVSISXRSSKSLLHSNGNTYLYWFLQRPGQSPQLLIYRMSNLVSGVPDRFSGSGSGTAFTLRISRVEAEDVGVYYXLQHLEYPFTFGPGTKLELKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 909 - protein, 216 aa, Artificial Sequence
  Synthesized sequence with two or more selenocysteine residues substituted for two or more cysteine residues
  VARIANT (1)...(216): Xaa = selenocysteine or cysteine
EIVLTQSPATLSLSPGERATLSXRASQSVSDAYLAWYQQKPGQAPRLLIYDASSRATGVPARFSGSGSGTDFTLTISSLEPEDFAVYYXHQYIQLHSFTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 910 - protein, 213 aa, Artificial Sequence
  Synthesized sequence with two or more selenocysteine residues substituted for two or more cysteine residues
  VARIANT (1)...(213): Xaa = selenocysteine or cysteine
QIVLSQSPAILSASPGEKVTMTXRASSSVSYMHWYQQKPGSSPKPWIYATSNLASGVPVRFSGSGSGTSYSLTISRVEAEDAATYYXQQWSSNPLTFGAGTKLELKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 911 - protein, 215 aa, Artificial Sequence
  Synthesized sequence with two or more selenocysteine residues substituted for two or more cysteine residues
  VARIANT (1)...(215): Xaa = selenocysteine or cysteine
DIQMTQSPSSLSASVGDRVTITXKASAAVGTYVAWYQQKPGKAPKLLIYSASYRKRGVPSRFSGSGSGTDFTLTISSLQPEDFATYYXHQYYTYPLFTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 912 - protein, 214 aa, Artificial Sequence
  Synthesized sequence with two or more selenocysteine residues substituted for two or more cysteine residues
  VARIANT (1)...(214): Xaa = selenocysteine or cysteine
SSELTQDPAVSVALGQTVRITXQGDSLRSYYATWYQQKPGQAPILVIYGENKRPSGIPDRFSGSSSGNTASLTITGAQAEDEADYYXKSRDGSGQHLVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPAEXS

SEQ ID NO: 913 - protein, 217 aa, Artificial Sequence
  Synthesized sequence with two or more selenocysteine residues substituted for two or more cysteine residues
  VARIANT (1)...(217): Xaa = selenocysteine or cysteine
AIQMTQSPSSLSASVGDRVTITXQASQSINNELSWYQQKPGKAPKLLIYRASTLASGVPSRFSGSGSGTDFTLTISSLQPDDFATYYXQQGYSLRNIDNAFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 914 - protein, 215 aa, Artificial Sequence
  Synthesized sequence with two or more selenocysteine residues substituted for two or more cysteine residues
  VARIANT (1)...(215): Xaa = selenocysteine or cysteine
DIQLTQSPSSLSASVGDRVTMTXSASSSVSSSYLYWYQQKPGKAPKLWIYSTSNLASGVPARFSGSGSGTDFTLTISSLQPEDSASYFXHQWNRYPYTFGGGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 915 - protein, 219 aa, Artificial Sequence
  Synthesized sequence with two or more selenocysteine residues substituted for two or more cysteine residues
  VARIANT (1)...(219): Xaa = selenocysteine or cysteine
DVVMTQSPLSLPVTPGEPASISXRSSQSLVHSNRNTYLHWYLQKPGQSPQLLIYKVSNRFSGVPDRFSGSGSGTDFTLKISRVEAEDVGVYYXSQNTHVPPTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 916 - protein, 211 aa, Artificial Sequence
  Synthesized sequence with two or more selenocysteine residues substituted for two or more cysteine residues
  VARIANT (1)...(211): Xaa = selenocysteine or cysteine
EIVLTQSPAIMSASPGERVTMTXSASSGVNYMHWYQQKPGTSPRRWIYDTSKLASGVPARFSGSGSGTDYSLTISSMEPEDAATYYXHQRGSYTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 917 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPGTLSLSPGERATLSXRASQGISRSYLAWYQQKPGQAPSLLIYGASSRATGIPDRFSGSGSGTDFTLTISRLEPEDFAVYYXQQFGSSPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 918 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQTPLSLSVTPGQPASISXKSSQSLLESDGKTYLNWYLQKPGQSPQLLIYLVSILDSGVPDRFSGSGSGTDFTLKISRVEAEDVGVYYXLQATHFPQTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 919 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPLSLPVTPGEPASISXRSSQSLVYSNGDTYLHWYLQKPGQSPQLLIYKVSNRFSGVPDRFSGSGSGTDFTLKISRVEAEDVGVYYXSQSTHVPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 920 - protein, 218 aa, Artificial Sequence
  Synthesized sequence with two or more selenocysteine residues substituted for two or more cysteine residues
  VARIANT (1)...(218): Xaa = selenocysteine or cysteine
DIQMTQSPSSLSASVGDRVTITXKASQSVDYDGHSYMNWYQQKPGKAPKLLIYAASNLESGVPSRFSGSGSGTDFTLTISSLQPEDFATYYXQQSDENPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 921 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQGIRNDLGWYQQKPGKAPKRLIYAASSLQSGVPSRFSGSGSGTEFILTVSSLQPEDFATYYXLQYNSNPFTFGPGTKVDIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 922 - protein, 219 aa, Artificial Sequence
  Synthesized sequence with two or more selenocysteine residues substituted for two or more cysteine residues
  VARIANT (1)...(219): Xaa = selenocysteine or cysteine
DIQMTQSPSSLSASVGDRVTITXRSSQSLVHSNGNTFLHWYQQKPGKAPKLLIYTVSNRFSGVPSRFSGSGSGTDFTLTISSLQPEDFATYFXSQTTHVPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 923 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSTLSASVGDRVTITXSASSSISYMHWYQQKPGKAPKLLIYTTSNLASGVPARFSGSGSGTEFTLTISSLQPDDFATYYXHQRSTYPLTFGQGTKVEVKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 924 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPLSLPVTPGQPASISXRSSQSIVHSNGNTWLQWWLQKPGQSPQLLIWKVSNRLWGVPDRFSGSGSGTDFTLKISRVQAQDVGVWWXFQGSHVPWTFGQGTKVQIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 925 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSLSPGERATLSXRASQSVSSYLAWYQQKPGQAPRLLIYDASNRATGIPARFSGSGSGTDFTLTISSLEPEDFAVYYXQQRSNWPPTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 926 - protein, 216 aa, Artificial Sequence
  Synthesized sequence with two or more selenocysteine residues substituted for two or more cysteine residues
  VARIANT (1)...(216): Xaa = selenocysteine or cysteine
EIVLTQSPATLSLSPGERAILSXRAGQSVSSYLVWYQQKPGQAPRLLIYDASNRATGIPARFSGSGSGTDFTLTISSLEPEDFAVYYXQQRSSWPPVYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 927 - protein, 218 aa, Artificial Sequence
  Synthesized sequence with two or more selenocysteine residues substituted for two or more cysteine residues
  VARIANT (1)...(218): Xaa = selenocysteine or cysteine
DIVMTQSPDSLAVSLGERATISXRASESVDNYGISFMKWFQQKPGQPPKLLIYAASNQGSGVPDRFSGSGSGTDFTLTISSLQAEDVAVYYXQQSKEVPWTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 928 - protein, 213 aa, Artificial Sequence
  Synthesized sequence with two or more selenocysteine residues substituted for two or more cysteine residues
  VARIANT (1)...(213): Xaa = selenocysteine or cysteine
EIVLTQSPATLSLSPGERATLSXSASSSVSYMHWYQQKPGQAPRLLIYDTSKLASGIPARFSGSGSGTDFTLTISSLEPEDVAVYYXFQGSVYPFTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 929 - protein, 214 aa, Artificial Sequence
  Synthesized sequence with two or more selenocysteine residues substituted for two or more cysteine residues
  VARIANT (1)...(214): Xaa = selenocysteine or cysteine
DILMTQSPSSMSVSLGDTVSITXHSSQDINSNIGWLQQKPGKSFKGLIYHGTNLDDEVPSRFSGSGSGADYSLTISSLESEDFADYYXVQYAQFPWTFGGGTKLEIKRADAAPTVSIFPPSSEQLTSGGASVVXFLNNFYPKDINVKWKIDGSERQNGVLNSWTDQDSKDSTYSMSSTLTLTKDEYERHNSYTXEATHKTSTSPIVKSFNRNEX

SEQ ID NO: 930 - protein, 215 aa, Artificial Sequence
  Synthesized sequence with two or more selenocysteine residues substituted for two or more cysteine residues
  VARIANT (1)...(215): Xaa = selenocysteine or cysteine
ENVLTQSPAIMSASPGEKVTMTXRASSSVSSSYLHWYQQKSGASPKLWIYSTSNLASGVPARFSGSGSGTSYSLTISSVEAEDAATYYXQQYSGYPLTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 931 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASENIYSYLAWYQQKPGKAPKLLIHNAKTLAEGVPSRFSGSGSGTDFTLTISSLQPEDFATYYXQHHYGAPLTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 932 - protein, 220 aa, Artificial Sequence
  Synthesized sequence with two or more selenocysteine residues substituted for two or more cysteine residues
  VARIANT (1)...(220): Xaa = selenocysteine or cysteine
EIVMTQSPATLSVSPGERATLSXRSSQSLVHRNGNTYLHWYLQKPGQSPKLLIHKVSNRFSGVPDRFSGSGSGTDFTLKISRVEAEDLGVYFXSQSTHVPPLTFGAGTKLELKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 933 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASQDVSTAVAWYQQKPGKAPKLLIYSASYRYTGVPSRFSGSGSGTDFTLTISSLQPEDFATYYXQQHYSTPWTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 934 - protein, 213 aa, Artificial Sequence
  Synthesized sequence with two or more selenocysteine residues substituted for two or more cysteine residues
  VARIANT (1)...(213): Xaa = selenocysteine or cysteine
SELTQDPAVSVALGQTVRITXSGDSLRSYYASWYQQKPGQAPVLVIYGANNRPSGIPDRFSGSSSGNTASLTITGAQAEDEADYYXNSADSSGNHVVFGGGTKLTVLGQPKAAPSVTLFPPSSEELQANKATLVXLISDFYPGAVTVAWKADSSPVKAGVETTTPSKQSNNKYAASSYLSLTPEQWKSHKSYSXQVTHEGSTVEKTVAPTEXS

SEQ ID NO: 935 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQNIATDVAWYQQKPGKAPKLLIYSASFLYSGVPSRFSGSGSGTDFTLTISSLQPEDFATYYXQQSEPEPYTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 936 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPLSLPVTPGEPASISXRSSQSLLYSIGYNYLDWYLQKSGQSPQLLIYLGSNRASGVPDRFSGSGSGTDFTLKISRVEAEDVGFYYXMQALQTPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 937 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPGTLSLSPGERATLSXRASQRVSSSYLAWYQQKPGQAPRLLIYDASSRATGIPDRFSGSGSGTDFTLTISRLEPEDFAVYYXQQYGSLPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 938 - protein, 217 aa, Artificial Sequence
  Synthesized sequence with two or more selenocysteine residues substituted for two or more cysteine residues
  VARIANT (1)...(217): Xaa = selenocysteine or cysteine
QSVLTQPPSVSAAPGQKVTISXSGSSSNIENNHVSWYQQLPGTAPKLLIYDNNKRPSGIPDRFSGSKSGTSATLGITGLQTGDEADYYXETWDTSLSAGRVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 939 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXGASENIYGALNWYQQKPGKAPKLLIYGATNLADGVPSRFSGSGSGTDFTLTISSLQPEDFATYYXQNVLNTPLTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 940 - protein, 216 aa, Artificial Sequence
  Synthesized sequence with two or more selenocysteine residues substituted for two or more cysteine residues
  VARIANT (1)...(216): Xaa = selenocysteine or cysteine
EIVLTQSPGTLSLSPGERATLSXRASQSVSSSYLAWYQQKPGQAPRLLIYGASSRATGIPDRFSGSGSGTDFTLTISRLEPEDFAVYYXQQYGSSPIFTFGPGTKVDIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 941 - protein, 215 aa, Artificial Sequence
  Synthesized sequence with two or more selenocysteine residues substituted for two or more cysteine residues
  VARIANT (1)...(215): Xaa = selenocysteine or cysteine
QSALTQPRSVSGSPGQSVTISXTGTSSSVGDSIYVSWYQQHPGKAPKLMLYDVTKRPSGVPDRFSGSKSGNTASLTISGLQAEDEADYYXYSYAGTDTLFGGGTKVTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 942 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQGISNWLAWYQQKPGKAPKLLIYGASSLQSGVPSRFSGSGSGTDFTLTISSLQPEDFATYYXQQYSSFPTTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 943 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASQDVGIAVAWYQQKPGKVPKLLIYWASTRHTGVPDRFSGSGSGTDFTLTISSLQPEDVATYYXQQYSSYPYTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 944 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSSLSASVGDRVTITXRASEDVNTYVSWYQQKPGKAPKLLIYAASNRYTGVPSRFSGSGSGTDFTLTISSLQPEDFATYYXQQSFSYPTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 945 - protein, 215 aa, Artificial Sequence
  Synthesized sequence with two or more selenocysteine residues substituted for two or more cysteine residues
  VARIANT (1)...(215): Xaa = selenocysteine or cysteine
DIQMTQSPSSLSASVGDRVTITXSVSSSVSSIYLHWYQQKPGKAPKLLIYSTSNLASGVPSRFSGSGSGTDFTLTISSLQPEDFATYYXQVYSGYPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 946 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASRNIERQLAWYQQKPGQAPELLIYQASRKESGVPDRFSGSRYGTDFTLTISSLQPEDIATYYXQQYSDPPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 947 - protein, 218 aa, Artificial Sequence
  Synthesized sequence with two or more selenocysteine residues substituted for two or more cysteine residues
  VARIANT (1)...(218): Xaa = selenocysteine or cysteine
DIQMTQSPSSLSASVGDRVTITXRASQSVSTSSYSYMHWYQQKPGKAPKLLIKYASNLESGVPSRFSGSGSGTDFTLTISSLQPEDFATYYXQHSWEIPYTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 948 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSVSASVGDRVTITXRASQGISGWLAWYQQKPGKAPKFLIYAASTLQSGVPSRFSGSGSGTDFTLTISSLQPEDFATYYXQQANSFPPTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 949 - protein, 216 aa, Artificial Sequence
  Synthesized sequence with two or more selenocysteine residues substituted for two or more cysteine residues
  VARIANT (1)...(216): Xaa = selenocysteine or cysteine
DIVLTQPPSVSGAPGQRVTISXSGSSSNIGSNSVSWYQQLPGTAPKLLIYDNSKRPSGVPDRFSGSKSGTSASLAITGLQSEDEADYYXQSRDTYGYYWVFGGGTKLTVLGQPKAAPSVTLFPPSSEELQANKATLVXLISDFYPGAVTVAWKGDSSPVKAGVETTTPSKQSNNKYAASSYLSLTPEQWKSHRSYSXQVTHEGSTVEKTVAPTEXS

SEQ ID NO: 950 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASQHVITHVTWYQQKPGKAPKLLIYGTSYSYSGVPSRFSGSGSGTDFTLTISSLQPEDFATYYXQQFYEYPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 951 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSLSPGERATLSXRASQSVSSYLAWYQQKPGQAPRLLIYDASNRATGIPARFSGSGSGTDFTLTISSLEPEDFAVYYXQHRSNWPPTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 952 - protein, 213 aa, Artificial Sequence
  Synthesized sequence with two or more selenocysteine residues substituted for two or more cysteine residues
  VARIANT (1)...(213): Xaa = selenocysteine or cysteine
QVVLTQSPVIMSASPGEKVTMTXSASSSISYMYWYQQKPGTSPKRWIYDTSKLASGVPARFSGSGSGTSYSLTISNMEAGDAATYYXHQRDSYPWTFGGGTNLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 953 - protein, 239 aa, Artificial Sequence
  Synthesized sequence with two or more selenocysteine residues substituted for two or more cysteine residues
  VARIANT (1)...(239): Xaa = selenocysteine or cysteine
MKLPVRLLVLLLFWIPASRGDVQVTQSPSSLSASVGDRVTITXRSSQSLANSYGNTFLSWYLHKPGKAPQLLIYGISNRFSGVPDRFSGSGSGTDFTLTISSLQPEDFATYYXLQGTHQPYTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 954 - protein, 219 aa, Artificial Sequence
  Synthesized sequence with two or more selenocysteine residues substituted for two or more cysteine residues
  VARIANT (1)...(219): Xaa = selenocysteine or cysteine
QVLTQSPSSLSASVGDRVTINXQASQSVYHNTYLAWYQQKPGKVPKQLIYDASTLASGVPSRFSGSGSGTDFTLTISSLQPEDVATYYXLGSYDXTNGDXFVFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 955 - protein, 216 aa, Artificial Sequence
  Synthesized sequence with two or more selenocysteine residues substituted for two or more cysteine residues
  VARIANT (1)...(216): Xaa = selenocysteine or cysteine
QSVLTQPPSVSAAPGQKVTISXSGSSSNIGNNYVSWYQQLPGTAPKLLIYDNNKRPSGIPDRFSGSKSGTSTTLGITGLQTGDEADYYXGTWDSRLSAVVFGGGTKLTVLGQPKANPTVTLFPPSSEELQANKATLVXLISDFYPGAVTVAWKADGSPVKAGVETTKPSKQSNNKYAASSYLSLTPEQWKSHRSYSXQVTHEGSTVEKTVAPTEXS

SEQ ID NO: 956 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQDINNYLNWYQQKPGKAPKLLIYYTSTLHSGVPSRFSGSGSGTDYTLTISSLQPEDFATYYXQQGNTLPPTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 957 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSLSPGERATLSXQASQSISNFLHWYQQRPGQAPRLLIRYRSQSISGIPARFSGSGSGTDFTLTISSLEPEDFAVYYXQQSGSWPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 958 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASESVDDLLHWYQQKPGKAPKLLIKYASQSISGVPSRFSGSGSGTDFTLTISSLQPEDFATYYXQQGNSLPNTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 959 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSTLSASVGDRVTITXRASQSIRSWLAWYQQKPGKAPKLLIYKASSLESGVPSRFSGSGSGTEFTLTISSLQPDDFATYYXQQYNSYSYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 960 - protein, 217 aa, Artificial Sequence
  Synthesized sequence with two or more selenocysteine residues substituted for two or more cysteine residues
  VARIANT (1)...(217): Xaa = selenocysteine or cysteine
ESVLTQPPSVSGAPGQRVTISXTGSSSNIGAGYDVHWYQQLPGTAPKLLISGNSNRPSGVPDRFSGSKSGTSASLAITGLQAEDEADYYXQSYDSSLSGSVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 961 - protein, 217 aa, Artificial Sequence
  Synthesized sequence with two or more selenocysteine residues substituted for two or more cysteine residues
  VARIANT (1)...(217): Xaa = selenocysteine or cysteine
DIQLTQSPSSLSASVGDRVTITXSVSSSISSNNLHWYQQKPGKAPKPWIYGTSNLASGVPSRFSGSGSGTDYTFTISSLQPEDIATYYXQQWSSYPYMYTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 962 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASAGDRVTITXRASQAIRNDLGWYQQKPGKAPKRLIYAAFNLQSGVPSRFSGSGSGTEFTLTISSLQPEDLASYYXQQYNRYPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 963 - protein, 217 aa, Artificial Sequence
  Synthesized sequence with two or more selenocysteine residues substituted for two or more cysteine residues
  VARIANT (1)...(217): Xaa = selenocysteine or cysteine
QAVLTQPPSVSGAPGQRVTISXTGSSSNIGAGYGVHWYQQLPGTAPKLLIYGDSNRPSGVPDRFSGSKSGTSASLAITGLQAEDEADYYXQSYDNSLSGYVFGGGTQLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 964 - protein, 214 aa, Artificial Sequence
  Synthesized sequence with two or more selenocysteine residues substituted for two or more cysteine residues
  VARIANT (1)...(214): Xaa = selenocysteine or cysteine
DIVMTQSPDSLAMSLGERVTLNXKASENVVSYVSWYQQKPGQSPKLLIYGASNRESGVPDRFSGSGSATDFTLTISSVQAEDVADYHXGQSYNYPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 965 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQFPSSLSASVGDRVTITXRASQGIRNDLGWYQQKPGKAPKRLIYAASRLHRGVPSRFSGSGSGTEFTLTISSLQPEDFATYYXLQHNSYPXSFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 966 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPATLSLSPGERATLSXRASQSVSSYLAWYQQKPGQAPRLLIYDASNRATGIPARFSGSGSGTDFTLTISSLEPEDFAVYYXQQRSNWLMYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 967 - protein, 214 aa, Artificial Sequence
  Synthesized sequence with two or more selenocysteine residues substituted for two or more cysteine residues
  VARIANT (1)...(214): Xaa = selenocysteine or cysteine
AIQLTQSPSSLSASVGDRVTITXRASQGISSALAWYQQKPGKAPKLLIYDASSLESGVPSRFSGSGSGTDFTLTISSLQPEDFATYYXQQFNSYPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 968 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSTLSASVGDRVTITXKASENVDTYVSWYQQKPGKAPKLLIYGASNRYTGVPSRFSGSGSGTDFTLTISSLQPDDFATYYXGQSYNYPFTFGQGTKVEVKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 969 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPATLSLSPGERATLSXRASQSVSSYLAWYQQKPGQAPRLLIYDASNRATGIPARFSGSGSGTDFTLTISSLEPEDFAVYYXQQRSNWPPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 970 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQGIRNDLGWYQQKPGKAPKLLIYAASSLQSGVPSRFSGSGSGTDFTLTISSLQPEDFATYYXQQLNSYPPTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 971 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSLSPGERATLSXKASKRVTTYVSWYQQKPGQAPRLLIYGASNRYLGIPARFSGSGSGTDFTLTISSLEPEDFAVYYXSQSYNYPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 972 - protein, 215 aa, Artificial Sequence
  Synthesized sequence with two or more selenocysteine residues substituted for two or more cysteine residues
  VARIANT (1)...(215): Xaa = selenocysteine or cysteine
ETVLTQSPGTLSLSPGERATLSXRASQSLGSSYLAWYQQKPGQAPRLLIYGASSRAPGIPDRFSGSGSGTDFTLTISRLEPEDFAVYYXQQYADSPITFGQGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 973 - protein, 214 aa, Artificial Sequence; identical to SEQ ID NO: 967
  Synthesized sequence with two or more selenocysteine residues substituted for two or more cysteine residues
  VARIANT (1)...(214): Xaa = selenocysteine or cysteine

SEQ ID NO: 974 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQTTSSLSASLGDRVTISXRTSQDIGNYLNWYQQKPDGTVKLLIYYTSRLHSGVPSRFSGSGSGTDFSLTINNVEQEDVATYFXQHYNTVPPTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 975 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASKDISKYLNWYQQKPGKAPKLLIYYTSGYHSGVPSRFSGSGSGTDFTLTISSLQPEDFATYYXQQGDALPPTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 976 - protein, 236 aa, Artificial Sequence
  Synthesized sequence with two or more selenocysteine residues substituted for two or more cysteine residues
  VARIANT (1)...(236): Xaa = selenocysteine or cysteine
MRVPAQLLGLLLLWLPGARXESALTQPPSVSGAPGQKVTISXTGSTSNIGGYDLHWYQQLPGTAPKLLIYDINKRPSGISDRFSGSKSGTAASLAITGLQTEDEADYYXQSYDSSLNAQVFGGGTRLTVLGQPKAAPTVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 977 - protein, 219 aa, Artificial Sequence
  Synthesized sequence with two or more selenocysteine residues substituted for two or more cysteine residues
  VARIANT (1)...(219): Xaa = selenocysteine or cysteine
DVVMTQSPLSLPVTPGEPASISXRSSQSLLHSNGYNYLDWYLQKPGQSPQLLIYLGSNRASGVPDRFSGSGSGTDFTLKISRVEAEDVGVYYXMQGTHWPLTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 978 - protein, 215 aa, Artificial Sequence
  Synthesized sequence with two or more selenocysteine residues substituted for two or more cysteine residues
  VARIANT (1)...(215): Xaa = selenocysteine or cysteine
DIVLTQSPATLSLSPGERATLSXRASQSVSSSYLAWYQQKPGQAPRLLIYGASSRATGVPARFSGSGSGTDFTLTISSLEPEDFATYYXLQIYNMPITFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 979 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSTSSLSASVGDRVTITXRASQDISNYLSWYQQKPGKAVKLLIYYTSKLHSGVPSRFSGSGSGTDYTLTISSLQQEDFATYFXLQGKMLPWTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 980 - protein, 214 aa, Artificial Sequence
  Synthesized sequence with two or more selenocysteine residues substituted for two or more cysteine residues
  VARIANT (1)...(214): Xaa = selenocysteine or cysteine
DIVMTQSQRFMSTTVGDRVSITXKASQNVVSAVAWYQQKPGQSPKLLIYSASNRYTGVPDRFTGSGSGTDFTLTISNMQSEDLADFFXQQYSNYPWTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 981 - protein, 215 aa, Artificial Sequence
  Synthesized sequence with two or more selenocysteine residues substituted for two or more cysteine residues
  VARIANT (1)...(215): Xaa = selenocysteine or cysteine
EIVMTQSPATLSVSPGERATLSXRASQSVDNNLVWYQQKPGQAPRLLIYGASTRATGIPARFSGSGSGTEFTLTISSLQSEDFAVYYXQQYNNWPPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 982 - protein, 217 aa, Artificial Sequence
  Synthesized sequence with two or more selenocysteine residues substituted for two or more cysteine residues
  VARIANT (1)...(217): Xaa = selenocysteine or cysteine
QSVLTQPPSVSGAPGQRVTISXTGSSSNIGSGYDVHWYQQLPGTAPKLLIYGNSKRPSGVPDRFSGSKSGTSASLAITGLQSEDEADYYXASWTDGLSLVVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 983 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPDSLAVSLGERVTMNXKSSQSLLYSTNQKNYLAWYQQKPGQSPKLLIYWASTRESGVPDRFSGSGSGTDFTLTISSVQAEDVAVYYXQQYYSYRTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 984 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPGTLSLSPGERATLSXRASQSVSSSYLAWYQQKPGQAPRLLIYGASSRATGIPDRFSGSGSGTDFTLTISRLEPEDFAVYYXQQYGSSPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 985 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSFLSASVGDRVTITXRASQGIISYLAWYQQKPEKAPKRLIYAASSLQSGVPSRFSGSGSGTEFTLTISSLQPEDFATYYXGQYANYPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 986 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRSSQRIMTYLNWYQQKPGKAPKLLIFVASHSQSGVPSRFRGSGSETDFTLTISGLQPEDSATYYXQQSFWTPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 987 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSSLSASVGDRVTITXRASQGINNYLNWYQQKPGKAPKRLIYNTNNLQTGVPSRFSGSGSGTEFTLTISSLQPEDFATYYXLQHNSFPTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 988 - protein, 214 aa, Artificial Sequence; identical to SEQ ID NO: 813
  Synthesized sequence with two or more selenocysteine residues substituted for two or more cysteine residues
  VARIANT (1)...(214): Xaa = selenocysteine or cysteine

SEQ ID NO: 989 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSTSSLSASLGDRVTISXSASQGINNYLNWYQQKPDGTVELLIYYTSTLQSGVPSRFSGSGSGTDYSLTISNLEPEDIGTYYXQQYSKLPRTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 990 - protein, 214 aa, Artificial Sequence
  Synthesized sequence with two or more selenocysteine residues substituted for two or more cysteine residues
  VARIANT (1)...(214): Xaa = selenocysteine or cysteine
EIVMTQSPATLSVSPGERATLSXRASQSVSRNLAWYQQKPGQAPRLLIYGASTRATGIPARFSGSGSGTEFTLTIGSLQSEDFAVYYXQQYKTWPRTFGQGTNVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 991 - protein, 214 aa, Artificial Sequence; identical to SEQ ID NO: 990
  Synthesized sequence with two or more selenocysteine residues substituted for two or more cysteine residues
  VARIANT (1)...(214): Xaa = selenocysteine or cysteine

SEQ ID NO: 992 - protein, 218 aa, Artificial Sequence
  Synthesized sequence with two or more selenocysteine residues substituted for two or more cysteine residues
  VARIANT (1)...(218): Xaa = selenocysteine or cysteine
EIVLTQSPDFQSVTPKEKVTITXRASESVDTFGISFMNWFQQKPDQSPKLLIHEASNQGSGVPSRFSGSGSGTDFTLTINSLEAEDAATYYXQQSKEVPFTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 993 - protein, 239 aa, Artificial Sequence; identical to SEQ ID NO: 953
  Synthesized sequence with two or more selenocysteine residues substituted for two or more cysteine residues
  VARIANT (1)...(239): Xaa = selenocysteine or cysteine

SEQ ID NO: 994 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPATLSLSPGERATLSXRASQSVSSYLAWYQQKPGQAPRLLIYDASNRATGIPARFSGSGSGTDFTLTISSLEPEDFAVYYXQQRSNWPPFTFGPGTKVDIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 995 - protein, 214 aa, Artificial Sequence
  Synthesized sequence with two or more selenocysteine residues substituted for two or more cysteine residues
  VARIANT (1)...(214): Xaa = selenocysteine or cysteine
DIVMTQSHLSMSTSLGDPVSITXKASQDVSTVVAWYQQKPGQSPRRLIYSASYRYIGVPDRFTGSGAGTDFTFTISSVQAEDLAVYYXQQHYSPPYTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 996 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASRDIRSYLTWYQQKPGKAPKTLIYYATSLADGVPSRFSGSGSGQDYSLTISSLESDDTATYYXLQHGESPFTLGSGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 997 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQTPLSLSVTPGQPASISXRSSRSLVHSRGNTYLHWYLQKPGQSPQLLIYKVSNRFIGVPDRFSGSGSGTDFTLKISRVEAEDVGVYYXSQSTHLPFTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 998 - protein, 213 aa, Artificial Sequence; identical to SEQ ID NO: 831
  Synthesized sequence with two or more selenocysteine residues substituted for two or more cysteine residues
  VARIANT (1)...(213): Xaa = selenocysteine or cysteine

SEQ ID NO: 999 - protein, 214 aa, Artificial Sequence
  Synthesized sequence with two or more selenocysteine residues substituted for two or more cysteine residues
  VARIANT (1)...(214): Xaa = selenocysteine or cysteine
DIQVTQSPSSLSASVGDRVTITXITSTDIDDDMNWYQQKPGKVPKLLISGGNTLRPGVPSRFSGSGSGTDFTLTISSLQPEDVATYYXLQSDSLPYTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1000 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSTLSASVGDRVTITXRASQSISSWLAWYQQKPGKAPKLLIYKASTLESGVPSRFSGSGSGTEFTLTISSLQPDDFATYYXQQYNTYWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1001 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPGTLSLSPGERATLSXRASSSVSSSYLHWYQQKPGQAPRLLIYSTSNLVAGIPDRFSGSGSGTDFTLTISRLEPEDFAVYYXQHHSGYHFTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1002 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASQDINNYLAWYQHKPGKGPKLLIHYTSTLHPGIPSRFSGSGSGRDYSFSISSLEPEDIATYYXLQYDNLLYTFGQGTKLEIKRTVAAPSVFIFPPSDEQLKSGTASVVSLLNNFYPREAKVQWKVDNALQSGNSQESVTEQDSKDSTYSLSSTLTLSKADYEKHKVYAXEVTHQGLSSPVTKSFNRGEX

SEQ ID NO: 1003 - protein, 218 aa, Artificial Sequence
  Synthesized sequence with two or more selenocysteine residues substituted for two or more cysteine residues
  VARIANT (1)...(218): Xaa = selenocysteine or cysteine
DIVMTQSPDSLSVSLGERATINXRASKSVDSYGNSFMHWYQQKPGQPPKLLIYLASNLESGVPDRFSGSGSGTDFTLTISSLQAEDVAVYYXQQNNEDPRTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1004 - protein, 218 aa, Artificial Sequence
  Synthesized sequence with two or more selenocysteine residues substituted for two or more cysteine residues
  VARIANT (1)...(218): Xaa = selenocysteine or cysteine
DIQMTQSPSSLSASVGDRVTITXRASESVDSYGNAFMHWYQQKPGKAPKLLIYRASNLESGVPSRFSGSGSGTDFTLTISSLQPEDFATYYXQQSNEDPYTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1005 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSVSPGERATLSXRASQSVGTNVAWYQQKPGQAPRVLIYSTSSRATGITDRFSGSGSGTDFTLTISRLEPEDFAVYYXQQFNKSPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1006 - protein, 214 aa, Artificial Sequence
  Synthesized sequence with two or more selenocysteine residues substituted for two or more cysteine residues
  VARIANT (1)...(214): Xaa = selenocysteine or cysteine
SSELTQDPAVSVALGQTVRITXQGDSLRSYYASWYQQKPGQAPVLVIYGKNNRPSGIPDRFSGSSSGNTASLTITGAQAEDEADYYXNSRDSSGNHVVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 1007 - protein, 219 aa, Artificial Sequence
  Synthesized sequence with two or more selenocysteine residues substituted for two or more cysteine residues
  VARIANT (1)...(219): Xaa = selenocysteine or cysteine
DIQMTQSPSSLSASVGDRVTITXRSSETLVHSSGNTYLEWYQQKPGKAPKLLIYRVSNRFSGVPSRFSGSGSGTDFTLTISSLQPEDFATYYXFQGSFNPLTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1008 - protein, 214 aa, Artificial Sequence
  Synthesized sequence with two or more selenocysteine residues substituted for two or more cysteine residues
  VARIANT (1)...(214): Xaa = selenocysteine or cysteine
EIVMTQSPATLSVSPGERATLSXRASQSIGTNIHWYQQKPGQAPRLLIYYASESISGIPARFSGSGSGTEFTLTISSLQSEDFAVYYXQQSWSWPTTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1009 - protein, 214 aa, Artificial Sequence
  Synthesized sequence with two or more selenocysteine residues substituted for two or more cysteine residues
  VARIANT (1)...(214): Xaa = selenocysteine or cysteine
DIVMTQSHKLLSTSVGDRVSITXKASQDVSTAVDWYQQKPGQSPKLLINWASTRHTGVPDRFTGSGSGTDYTLTISSMQAEDLALYYXRQHYSTPFTFGSGTKLEIKRADAAPTVSIFPPSSEQLTSGGASVVXFLNNFYPKDINVKWKIDGSERQNGVLNSWTDQDSKDSTYSMSSTLTLTKDEYERHNSYTXEATHKTSTSPIVKSFNRNEX

SEQ ID NO: 1010 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPVTLSLSPGERATLSXRASQSVSSYLAWYQQKPGQAPRLLIYDASNRATGIPARFSGSGSGTDFTLTISSLEPEDFAVYYXQQRSNWMYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1011 - protein, 213 aa, Artificial Sequence
  Synthesized sequence with two or more selenocysteine residues substituted for two or more cysteine residues
  VARIANT (1)...(213): Xaa = selenocysteine or cysteine
QIVLTQSPATLSVSPGERATLSXRASQSVSYMHWYQQKPGQAPRLLIYGVFRRATGIPDRFSGSGSGTDFTLTIGRLEPEDFAVYYXLQWSSDPPTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1012 - protein, 219 aa, Artificial Sequence
  Synthesized sequence with two or more selenocysteine residues substituted for two or more cysteine residues
  VARIANT (1)...(219): Xaa = selenocysteine or cysteine
DVVMTQSPLSLPVTLGQPASISXRSSQIIIHSDGNTYLEWFQQRPGQSPRRLIYKVSNRFSGVPDRFSGSGSGTDFTLKISRVEAEDVGVYYXFQGSHVPHTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1013 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPLSLTVTPGEPASISXRSSQSLLYSNGYNYLDWYLQKPGQSPQVLISLGSNRASGVPDRFSGSGSGTDFTLKISRVEAEDVGVYYXMQARQTPFTFGPGTKVDIRRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1014 - protein, 214 aa, Artificial Sequence
  Synthesized sequence with two or more selenocysteine residues substituted for two or more cysteine residues
  VARIANT (1)...(214): Xaa = selenocysteine or cysteine
DIVMTQSHKFMSTSVGDRVSITXKASQDVNTAVAWYQQKPGHSPKLLIYSASFRYTGVPDRFTGSRSGTDFTFTISSVQAEDLAVYYXQQHYTTPPTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1015 - protein, 217 aa, Artificial Sequence
  Synthesized sequence with two or more selenocysteine residues substituted for two or more cysteine residues
  VARIANT (1)...(217): Xaa = selenocysteine or cysteine
QSVLTQPPSVSGAPGQRVTISXTGSGSNIGAPYDVSWYQQLPGTAPKLLIYHNNKRPSGVPDRFSGSKSGTSASLAITGLQAEDEADYYXATVEAGLSGSVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 1016 - protein, 219 aa, Artificial Sequence
  Synthesized sequence with two or more selenocysteine residues substituted for two or more cysteine residues
  VARIANT (1)...(219): Xaa = selenocysteine or cysteine
DIQLTQSPLSLPVTLGQPASISXRSSQSLVHRNGNTYLHWFQQRPGQSPRLLIYTVSNRFSGVPDRFSGSGSGTDFTLKISRVEAEDVGVYFXSQSSHVPPTFGAGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1017 - protein, 218 aa, Artificial Sequence
  Synthesized sequence with two or more selenocysteine residues substituted for two or more cysteine residues
  VARIANT (1)...(218): Xaa = selenocysteine or cysteine
DIVLTQSPLSLAVSLGQPAIISXKASQSVSFAGTSLMHWYHQKPGQQPRLLIYRASNLEAGVPDRFSGSGSKTDFTLTISPVEAEDAATYYXQQSREYPYTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1018 - protein, 219 aa, Artificial Sequence
  Synthesized sequence with two or more selenocysteine residues substituted for two or more cysteine residues
  VARIANT (1)...(219): Xaa = selenocysteine or cysteine
DVLMTQSPLSLPVTPGEPASISXRSSRNIVHINGDTYLEWYLQKPGQSPQLLIYKVSNRFSGVPDRFSGSGSGTDFTLKISRVEAEDVGVYYXFQGSLLPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1019 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASENIYSYLAWYQQKPGKAPKLLIYNAKTLAEGVPSRFSGSGSGTDFTLTISSLQPEDFATYYXQHHYGTPRTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1020 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSTLSASVGDRVTITXSASSRVGYMHWYQQKPGKAPKLLIYDTSKLASGVPSRFSGSGSGTEFTLTISSLQPDDFATYYXFQGSGYPFTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1021 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSVSASVGDRVTIAXRASQNIRNILNWYQQRPGKAPQLLIYAASNLQSGVPSRFSGSGSGTDFTLTINSLQPEDFATYYXQQSYSMPRTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1022 - protein, 214 aa, Artificial Sequence
  Synthesized sequence with two or more selenocysteine residues substituted for two or more cysteine residues
  VARIANT (1)...(214): Xaa = selenocysteine or cysteine
SIVMTQTPTSLLVSAGDRVTITXKASQSVSNDVAWYQQKPGQSPKLLISYTSSRYAGVPDRFSGSGYGTDFTLTISSVQAEDAAVYFXQQDYNSPPTFGGGTKLEIKRADAAPTVSIFPPSSEQLTSGGASVVXFLNNFYPKDINVKWKIDGSERQNGVLNSWTDQDSKDSTYSMSSTLTLTKDEYERHNSYTXEATHKTSTSPIVKSFNRNES

SEQ ID NO: 1023 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSVSVGERVTITXRASENIRSNLAWYQQKPGKSPKLLVNVATNLADGVPSRFSGSGSGTDYSLKINSLQPEDFGTYYXQHYWGTTWTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1024 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSLSPGERATLSXRASQSVSRYLAWYQQKPGQAPRLLIYDASNRATGIPARFSGSGSGTDFTLTISSLEPEDFAVYYXQQRSNWPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1025 - protein, 218 aa, Artificial Sequence; identical to SEQ ID NO: 927
  Synthesized sequence with two or more selenocysteine residues substituted for two or more cysteine residues
  VARIANT (1)...(218): Xaa = selenocysteine or cysteine

SEQ ID NO: 1026 - protein, 214 aa, Artificial Sequence
  Synthesized sequence with two or more selenocysteine residues substituted for two or more cysteine residues
  VARIANT (1)...(214): Xaa = selenocysteine or cysteine
EIVMTQSPATLSLSPGERATLSXRASQSVSSYLAWYQQKPGQAPRLLIYDASNRATGIPARFSGSGSGTDFTLTISSLEPEDFAVYYXHQYGSTPLTFGGGTKAEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1027 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXQASEDIYSFVAWYQQKPGKAPKLLIYNAQTEAQGVPSRFSGSGSGTDFTLTISSLQPEDFATYYXQHHYDSPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1028 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPGTLSLSPGERATLSXRASQSVSSTYLAWYQQKPGQAPRLLIYGASSRATGIPDRFSGSGSGTDFTLTISRLEPEDFAVYYXQHYDNSQTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1029 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSLSPGERATLSXRASQSVSSYLAWYQQKPGQAPRLLIYDASNRATGIPARFSGSGSGTDFTLTISSLEPEDFAVYYXQQSSNWPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1030 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQTPLSLPVTPGEPASISXRSSKSLLHSNGITYLYWYLQKPGQSPQLLIYQMSNLVSGVPDRFSGSGSGTDFTLKISRVEAEDVGVYYXAQNLELPYTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1031 - protein, 213 aa, Artificial Sequence
  Synthesized sequence with two or more selenocysteine residues substituted for two or more cysteine residues
  VARIANT (1)...(213): Xaa = selenocysteine or cysteine
EIVLTQSPGTLSLSPGERATLSXRASSSVPYIHWYQQKPGQAPRLLIYATSALASGIPDRFSGSGSGTDFTLTISRLEPEDFAVYYXQQWLSNPPTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1032 - protein, 212 aa, Artificial Sequence
  Synthesized sequence with two or more selenocysteine residues substituted for two or more cysteine residues
  VARIANT (1)...(212): Xaa = selenocysteine or cysteine
DIQMTQSPSSLSASVGDRVTITXRASSSVSYMHWYQQKPGKAPKPLIYAPSNLASGVPSRFSGSGSGTDFTLTISSLQPEDFATYYXQQWSFNPPTFGQGTKVEIKRTVAAPSVFIFPPSDEQLKSGTASWXLLNNFYPREAKVQWKVDNALQSGNSQESVTEQDSKDSTYSLSSTLTLSKADYEKHKVYAXEVTHQGLSSPVTKSFNRGEX

SEQ ID NO: 1033 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSLSPGERATLSXRASQSVSSYLAWYQQKPGQAPRLLIYDASNRATGIPARFSGSGSGTDFTLTISSLEPEDFAVYYXQQRSNWPPAFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1034 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXQASQDIGISLSWYQQKPGKAPKLLIYNANNLADGVPSRFSGSGSGTDFTLTISSLQPEDFATYYXLQHNSAPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1035 - protein, 218 aa, Artificial Sequence
  Synthesized sequence with two or more selenocysteine residues substituted for two or more cysteine residues
  VARIANT (1)...(218): Xaa = selenocysteine or cysteine
DIQLTQSPSSLSASVGDRVTITXRASQSVDYDGDSYMNWYQQKPGKAPKLLIYAASYLESGVPSRFSGSGSGTDFTLTISSLQPEDFATYYXQQSHEDPYTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1036 - protein, 220 aa, Artificial Sequence
  Synthesized sequence with two or more selenocysteine residues substituted for two or more cysteine residues
  VARIANT (1)...(220): Xaa = selenocysteine or cysteine
DIQMTQSPSSLSASVGDRVTITXKSSQSLLYTSSQKNYLAWYQQKPGKAPKLLIYWASTRESGVPSRFSGSGSGTDFTLTISSLQPEDFATYYXQQYYAYPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1037 - protein, 215 aa, Artificial Sequence
  Synthesized sequence with two or more selenocysteine residues substituted for two or more cysteine residues
  VARIANT (1)...(215): Xaa = selenocysteine or cysteine
DIQMTQSPSSLSASVGDRVTITXRASQNVGTAVAWLQQTPGKAPKLLIYSASNRYTGVPSRFSGSGSGTDYTFTISSLQPEDIATYYXQQYTNYPMYTFGQGTKVQIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1038 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPGTLSLSPGERATLSXRASQSVSSYLAWYQQKPGQAPRLLIYDASNRATGIPARFSGSGSGTEFTLTISSLQSEDFAVYYXQQYDKWPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1039 - protein, 216 aa, Artificial Sequence
  Synthesized sequence with two or more selenocysteine residues substituted for two or more cysteine residues
  VARIANT (1)...(216): Xaa = selenocysteine or cysteine
QSVLTQPPSASGTPGQRVTISXSGSNTNIGKNYVSWYQQLPGTAPKLLIYANSNRPSGVPDRFSGSKSGTSASLAISGLRSEDEADYYXASWDASLNGWVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 1040 - protein, 216 aa, Artificial Sequence
  Synthesized sequence with two or more selenocysteine residues substituted for two or more cysteine residues
  VARIANT (1)...(216): Xaa = selenocysteine or cysteine
DIQLTQPNSVSTSLGSTVKLSXTLSSGNIENNYVHWYQLYEGRSPTTMIYDDDKRPDGVPDRFSGSIDRSSNSAFLTIHNVAIEDEAIYFXHSYVSSFNVFGGGTKLTVLRQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 1041 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQGISSWLAWYQQKPEKAPKSLIYAASSLQSGVPSRFSGSGSGTDFTLTISSLQPEDFATYYXQQYNSYPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1042 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPLSNPVTLGQPVSISXRSSKSLLYKDGKTYLNWFLQRPGQSPQLLIYLMSTRASGVPDRFSGGGSGTDFTLKISRVEAEDVGVYYXQQLVEYPLTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1043 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSTLSASVGDRVTITXKXQLSVGYMHWYQQKPGKAPKLLIYDTSKLASGVPSRFSGSGSGTEFTLTISSLQPDDFATYYXFQGSGYPFTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1044 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQGISSWLAWYQQKPEKAPKSLIYAASSLQSGVPSRFSGSGSGTDFTLTISSLQPEDFATYYXQQYNSYPPTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1045 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXQASQDISNYLNWYQQKPGKAPKLLIYDASNLETGVPSRFSGSGSGTDFTFTISSLQPEDIATYFXQHFDHLPLAFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1046 - protein, 219 aa, Artificial Sequence
  Synthesized sequence with two or more selenocysteine residues substituted for two or more cysteine residues
  VARIANT (1)...(219): Xaa = selenocysteine or cysteine
DIQMTQSPSSLSASVGDRVTITXRTSQSLVHINAITYLHWYQQKPGKAPKLLIYRVSNRFSGVPSRFSGSGSGTDFTLTISSLQPEDFATYYXGQSTHVPLTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1047 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQAVSSAVAWYQQKPGKAPKLLIYSASHRYTGVPSRFSGSGSGTDFTLTISSLQPEDFATYYXQESYSTPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1048 - protein, 220 aa, Artificial Sequence
  Synthesized sequence with two or more selenocysteine residues substituted for two or more cysteine residues
  VARIANT (1)...(220): Xaa = selenocysteine or cysteine
DIEMTQSPDSLAVSLGERATINXRSSQSVLYSSSNRNYLAWYQQNPGQPPKLLIYWASTRESGVPDRFSGSGSGTDFTLTISSLQAEDVAVYYXQQYYSTPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1049 - protein, 218 aa, Artificial Sequence
  Synthesized sequence with two or more selenocysteine residues substituted for two or more cysteine residues
  VARIANT (1)...(218): Xaa = selenocysteine or cysteine
EIVLTQSPATLSLSPGERATLSXRASKGVSTSGYSYLHWYQQKPGQAPRLLIYLASYLESGVPARFSGSGSGTDFTLTISSLEPEDFAVYYXQHSRDLPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1050 - protein, 215 aa, Artificial Sequence
  Synthesized sequence with two or more selenocysteine residues substituted for two or more cysteine residues
  VARIANT (1)...(215): Xaa = selenocysteine or cysteine
DIQMTQSPSSLSASVGDRVTITXRASQDINSYLSWFQQKPGKAPKSLIVRANRLVDGVPSRFSGSGSGQDYSLTISSLQPEDFATYYXLQYDAFPPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1051 - protein, 213 aa, Artificial Sequence
  Synthesized sequence with two or more selenocysteine residues substituted for two or more cysteine residues
  VARIANT (1)...(213): Xaa = selenocysteine or cysteine
EIVLTQSPSSLSASVGDRVTITXSARSSVSYMHWFQQKPGKAPKLWIYRTSNLASGVPSRFSGSGSGTSYXLTINSLQPEDFATYYXQQRSSFPLTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1052 - protein, 219 aa, Artificial Sequence
  Synthesized sequence with two or more selenocysteine residues substituted for two or more cysteine residues
  VARIANT (1)...(219): Xaa = selenocysteine or cysteine
DIQMTQSPSSLSASVGDRVTITXRSSQSIVHSVGNTFLEWYQQKPGKAPKLLIYKVSNRFSGVPSRFSGSGSGTDFTLTISSLQPEDFATYYXFQGSQFPYTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1053 - protein, 219 aa, Artificial Sequence
  Synthesized sequence with two or more selenocysteine residues substituted for two or more cysteine residues
  VARIANT (1)...(219): Xaa = selenocysteine or cysteine
DVVMTQSPLSLPVTLGQPASISXKSSQSLLDSDGKTFLNWFQQRPGQSPRRLIYLVSKLDSGVPDRFSGSGSGTDFTLKISRVEAEDVGVYYXWQGTHFPYTFGQGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1054 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQDISNYLNWYQQKPGKAPKLLIYYTSRLRSGVPSRFSGSGSGTDFTLTISSLQPEDFATYYXQQGHTLPPTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1055 - protein, 218 aa, Artificial Sequence
  Synthesized sequence with two or more selenocysteine residues substituted for two or more cysteine residues
  VARIANT (1)...(218): Xaa = selenocysteine or cysteine
DIQLTQSPSSLSASVGDRVTITXKASQSVDYEGDSFLNWYQQKPGKAPKLLIYAASNLESGVPSRFSGSGSGTDFTLTISSLQPEDFATYYXQQSNEDPLTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1056 - protein, 219 aa, Artificial Sequence
  Synthesized sequence with two or more selenocysteine residues substituted for two or more cysteine residues
  VARIANT (1)...(219): Xaa = selenocysteine or cysteine
DVVMTQSPLSLPVTLGQPASISXKSSQSLLYSDAKTYLNWFQQRPGQSPRRLIYQISRLDPGVPDRFSGSGSGTDFTLKISRVEAEDVGVYYXLQGTHYPVLFGQGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1057 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQGISNWLAWYQQKPEKAPKSLIYAASSLQSGVPSRFSGSGSGTDFTLTISSLQPEDFATYYXQQYDSYPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1058 - protein, 214 aa, Artificial Sequence
  Synthesized sequence with two or more selenocysteine residues substituted for two or more cysteine residues
  VARIANT (1)...(214): Xaa = selenocysteine or cysteine
DIVMSQSHKFMSTSVGDRVSITXKASQDVGTAVAWYQQNPGQSPKFLIYWASTRHTGVPDRFTGSGSGTDFTLTITNVQSEDLADYFXQQYSSYPLTFGAGTSLELKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1059 - protein, 219 aa, Artificial Sequence
  Synthesized sequence with two or more selenocysteine residues substituted for two or more cysteine residues
  VARIANT (1)...(219): Xaa = selenocysteine or cysteine
DIQMTQSPSSLSASVGDRVTITXRSSQSLVHNNANTYLHWYQQKPGKAPKLLIYKVSNRFSGVPSRFSGSGSGTDFTLTISSLQPEDFATYYXSQNTLVPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1060 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQTTSSLSASLGDRVTISXRASQDISNYLNWYQQKPDGTVKLLIYYTSRLHSGVPSRFSGSGSGTDYSLTISNLEQEDIATYFXQQGNTLPWTFGGGTKLEIKRADAAPTVSIFPPSSEQLTSGGASVVXFLNNFYPKDINVKWKIDGSERQNGVLNSWTDQDSKDSTYSMSSTLTLTKDEYERHNSYTXEATHKTSTSPIVKSFNRNEX

SEQ ID NO: 1061 - protein, 218 aa, Artificial Sequence
  Synthesized sequence with two or more selenocysteine residues substituted for two or more cysteine residues
  VARIANT (1)...(218): Xaa = selenocysteine or cysteine
QSALTQPRSVSGSPGQSVTISXTGTSSDIGGYNFVSWYQQHPGKAPKLMIYDATKRPSGVPDRFSGSKSGNTASLTISGLQAEDEADYYXXSYAGDYTPGVVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 1062 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASQDVHTAVAWYQQKPGKAPKLLIYHASYRYTGVPSRFSGSGSGTDFTFTISSLQPEDIATYYXQQRYSLWRTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1063 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSVSASIGDRVTITXRASQGIDNWLGWYQQKPGKAPKLLIYDASNLDTGVPSRFSGSGSGTYFTLTISSLQAEDFAVYFXQQAKAFPPTFGGGTKVDIKGTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1064 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQSPDSLAVSLGERATINXKSSHSVLYSSNQKNYLAWYQQKPGQPPKLLIYWASTRESGVPDRFSGSGSGTDFTLTISSLQAEDVAVYYXHQYLSSLTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1065 - protein, 331 aa, Artificial Sequence
  Synthesized sequence with two or more selenocysteine residues substituted for two or more cysteine residues
  VARIANT (1)...(331): Xaa = selenocysteine or cysteine
DIQMTQSPSSLSASVGDRVTITXRASQGIRNYLAWYQQKPGKAPKLLIYAASTLQSGVPSRFSGSGSGTDFTLTISSLQPEDVATYYXQRYNRAPYTFGQGTKVEIKRGGSGGGGSGEIVLTQSPDFQSVTPKEKVTITXRASQDIGSELHWYQQKPDQPPKLLIKYASHSTSGVPSRFSGSGSGTDFTLTINGLEAEDAGTYYXHQTDSLPYTFGPGTKVDIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1066 - protein, 215 aa, Artificial Sequence
  Synthesized sequence with two or more selenocysteine residues substituted for two or more cysteine residues
  VARIANT (1)...(215): Xaa = selenocysteine or cysteine
EIVMTQSPATLSVSPGERATLSXRASQSVDSNLAWYRQKPGQAPRLLIYGASTRATGIPARFSGSGSGTEFTLTISSLQSEDFAVYYXQQYINWPPITFGQGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1067 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPDTISLSPGERATLSXRASQSISSIYLAWYQQKPGQAPRLLIYGASSRVTGIPDRFSVSGSGTDFTLTISRLEPEDFAVYYXQHYGISPFTFGPGTKVDIRRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1068 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASRDVAIAVAWYQQKPGKVPKLLIYWASTRHTGVPSRFSGSGSRTDFTLTISSLQPEDVADYFXHQYSSYPFTFGSGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1069 - protein, 213 aa, Artificial Sequence
  Synthesized sequence with two or more selenocysteine residues substituted for two or more cysteine residues
  VARIANT (1)...(213): Xaa = selenocysteine or cysteine
QIVLSQSPAILSASPGEKVTMTXRASSSVSYIHWFQQKPGSSPKPWIYATSNLASGVPVRFSGSGSGTSYSLTISRVEAEDAATYYXQQWTSNPPTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1070 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPGTLSVSPGERATLSXRASQSIGSSLHWYQQKPGQAPRLLIKYASQSLSGIPDRFSGSGSGTDFTLTISRLEPEDFAVYYXHQSSRLPHTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1071 - protein, 214 aa, Artificial Sequence; identical to SEQ ID NO: 832
  Synthesized sequence with two or more selenocysteine residues substituted for two or more cysteine residues
  VARIANT (1)...(214): Xaa = selenocysteine or cysteine

SEQ ID NO: 1072 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQDISNYLNWYQQKPGKAPKLLIYYTSRLLSGVPSRFSGSGSGTDFTLTISSLQPEDFATYYXQQGDTLPYTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1073 - protein, 218 aa, Artificial Sequence
  Synthesized sequence with two or more selenocysteine residues substituted for two or more cysteine residues
  VARIANT (1)...(218): Xaa = selenocysteine or cysteine
DIQMTQSPSSLSASVGDRVTITXRASQSVSTSSYSYMHWYQQKPGKAPKVLISYASNLESGVPSRFSGSGSGTDFTLTISSLQPEDFATYYXQHSWGIPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1074 - protein, 218 aa, Artificial Sequence
  Synthesized sequence with two or more selenocysteine residues substituted for two or more cysteine residues
  VARIANT (1)...(218): Xaa = selenocysteine or cysteine
DIQMTQSPSSLSASVGDRVTITXKASQSVDYDGDSYMNWYQQKPGKAPKLLIYAASNLESGVPSRFSGSGSGTDFTLTISPVQAEDFATYYXQQSNEDPLTFGAGTKLELKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1075 - protein, 214 aa, Artificial Sequence
  Synthesized sequence with two or more selenocysteine residues substituted for two or more cysteine residues
  VARIANT (1)...(214): Xaa = selenocysteine or cysteine
EIVMTQSPATLSVSPGERATLSXKASQSVSNDVVWYQQKPGQAPRLLIYYASNRYTGIPARFSGSGSGTEFTLTISSLQSEDFAVYYXQQDYTSPWTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1076 - protein, 219 aa, Artificial Sequence
  Synthesized sequence with two or more selenocysteine residues substituted for two or more cysteine residues
  VARIANT (1)...(219): Xaa = selenocysteine or cysteine
DIQMTQSPSSLSASVGDRVTITXKSSQSLVGASGKTYLYWLFQKPGKAPKRLIYLVSTLDSGIPSRFSGSGSGTEFTLTISSLQPEDFATYYXLQGTHFPHTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1077 - protein, 233 aa, Artificial Sequence
  Synthesized sequence with two or more selenocysteine residues substituted for two or more cysteine residues
  VARIANT (1)...(233): Xaa = selenocysteine or cysteine
MGWSXIILFLVATATGVHSDIQLTQSPSSLSASVGDRVSITXKASQDVSIAVAWYQQKPGKAPKLLIYSASYRYTGVPDRFSGSGSGTDFTLTISSLQPEDFAVYYXQQHYITPLTFGAGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1078 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASIGDRVTITXKASQDINSYLSWFQQKPGKAPKLLIYRANRLVDGVPSRFSGSGSGTDYTLTISSLQPEDFAVYYXLQYDEFPYTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1079 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDSVTITXQASTDISSHLNWYQQKPGKAPELLIYYGSHLLSGVPSRFSGSGSGTDFTFTISSLEAEDAATYYXGQGNRLPYTFGQGTKVEIERTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1080 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSVSASVGDRVTITXRASQGISSWLAWYQQKPGKAPKLLIYGASSLESGVPSRFSGSGSGTDFTLTISSLQPEDFASYYXQQANSFPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1081 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPGTLSLSPGERATLSXRASQSVSSSYLAWYQQKPGQAPRLLIYGASSRATGIPDRFSGSGSGTDFTLTISRLEPEDFAVYYXQQYGSSPXTFGQGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1082 - protein, 217 aa, Artificial Sequence
  Synthesized sequence with two or more selenocysteine residues substituted for two or more cysteine residues
  VARIANT (1)...(217): Xaa = selenocysteine or cysteine
QSALTQPASVSGSPGQSITISXTGTSSDVGSYNVVSWYQQHPGKAPKLIIYEVSQRPSGVSNRFSGSKSGNTASLTISGLQTEDEADYYXXSYAGSSIFVIFGGGTKVTVLGQPKAAPSVTLFPPSSEELQANKATLVXLVSDFYPGAVTVAWKADGSPVKVGVETTKPSKQSNNKYAASSYLSLTPEQWKSHRSYSXRVTHEGSTVEKTVAPAEXS

SEQ ID NO: 1083 - protein, 220 aa, Artificial Sequence
  Synthesized sequence with two or more selenocysteine residues substituted for two or more cysteine residues
  VARIANT (1)...(220): Xaa = selenocysteine or cysteine
DIVLSQSPSSLVVSVGEKVTMSXKSSQSLLYSRNQKNYLAWYQQKPGQSPKVLIYWASTRESGVPDRLTGSGSGTDFTLTISSVKAEDLAVYYXQQYYSYPLTFGAGTKLELKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1084 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPGTLSLSPGERATLSXRASQSVSSTYLAWYQQKPGQAPRLLIYGASSRATGIPDRFSGSGSGTDFTLTISRLEPEDFAVYYXQQYGSSPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1085 - protein, 213 aa, Artificial Sequence
  Synthesized sequence with two or more selenocysteine residues substituted for two or more cysteine residues
  VARIANT (1)...(213): Xaa = selenocysteine or cysteine
QIVLIQSPAIMSASPGEKVTMTXSASSSVSYMYWYQQKPGSSPRLLIYDTSNLASGVPVRFSGSGSGTSYSLTISRMEAEDAATYYXQQWSGYPYTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1086 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQTPLSLSVTPGQPASISXRSSKSLLHSNGNTYLYWFLQKPGQSPQFLIYRMSNLASGVPDRFSGSGSGTDFTLKISRVEAEDVGVYYXMQHLEYPYTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1087 - protein, 213 aa, Artificial Sequence
  Synthesized sequence with two or more selenocysteine residues substituted for two or more cysteine residues
  VARIANT (1)...(213): Xaa = selenocysteine or cysteine
EIVLTQSPATLSLSPGERATLSXSASISVSYMYWYQQKPGQAPRLLIYDMSNLASGIPARFSGSGSGTDFTLTISSLEPEDFAVYYXMQWSGYPYTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1088 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXKASDLIHNWLAWYQQKPGKAPKLLIYGATSLETGVPSRFSGSGSGTDFTLTISSLQPEDFATYYXQQYWTTPFTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1089 - protein, 219 aa, Artificial Sequence
  Synthesized sequence with two or more selenocysteine residues substituted for two or more cysteine residues
  VARIANT (1)...(219): Xaa = selenocysteine or cysteine
DVVMTQSPLSLPVTLGQPASISXRSSQSLIYSDGNAYLHWFLQKPGQSPRLLIYKVSNRFSGVPDRFSGSGSGTDFTLKISRVEAEDVGVYYXSQSTHVPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1090 - protein, 220 aa, Artificial Sequence
  Synthesized sequence with two or more selenocysteine residues substituted for two or more cysteine residues
  VARIANT (1)...(220): Xaa = selenocysteine or cysteine
DIQMTQRPDSLSASVGDRVTMSXKSSQSLLNSGDQKNYLTWYQQKPGQPPKLLIYWASTGESGVPDRFSGSGSGTDFTFTISSLQPEDIATYYXQNDYSYPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1091 - protein, 214 aa, Artificial Sequence
  Synthesized sequence with two or more selenocysteine residues substituted for two or more cysteine residues
  VARIANT (1)...(214): Xaa = selenocysteine or cysteine
EIVLTQSPATLSLSPGERATLSXRASQSVSRYLAWYQQKPGQAPRLLIYDASNRATGIPARFSGSGSGTDSTLTISSLEPEDFAVYYXQQRSNWPRTFGQGTKVEIKRTVAAPSVFIFPPSDEQLKSGTASVVXLLNNFYPREAKVQWKVDNALQSGNSQESVTEQDSKDSTYSLSNTLTLSKADYEKHKVYAXEVTHQGLSSPVTKSFNRGEX

SEQ ID NO: 1092 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQTPSTLSASVGDRVTISXRASQDINNYLNWYQQKPGKAPKLLIYYTSTLHSGVPSRFSGSGSGTDYTLTISSLQPDDFATYFXQQGNTLPWTFGQGTKVEVKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1093 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQSISNNLNWYQQKPGKAPKLLIYYTSRFHSGVPSRFSGSGSGTDFTFTISSLQPEDIATYYXQQEHTLPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1094 - protein, 215 aa, Artificial Sequence
  Synthesized sequence with two or more selenocysteine residues substituted for two or more cysteine residues
  VARIANT (1)...(215): Xaa = selenocysteine or cysteine
DIVLTQSPATLSLSPGERATLSXRASQSVRSNYLAWYQQKPGQAPRLLIYGASSRATGVPARFSGSGSGTDFTLTISSLEPEDFAVYYXQQYSNFPITFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1095 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQDISNYLNWYQQKPGKAPKLLIYYTSKLHSGVPSRFSGSGSGTDYTLTISSLQPEDFATYYXQQGSALPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1096 - protein, 218 aa, Artificial Sequence
  Synthesized sequence with two or more selenocysteine residues substituted for two or more cysteine residues
  VARIANT (1)...(218): Xaa = selenocysteine or cysteine
DIVMTQSPDSLAVSLGERATINXKSSESVDSYANSFLHWYQQKPGQPPKLLIYRASTRESGVPDRFSGSGSGTDFTLTISSLQAEDVAVYYXQQSKEDPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1097 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQAAPSVPVTPGESVSISXRSSKSLLHSNGNTYLYWFLQRPGQSPQLLIYRMSNLASGVPDRFSGSGSGTAFTLRISRVEAEDVGVYYXMQHLEYPLTFGAGTKLELKRADAAPTVSIFPPSSEQLTSGGASVVXFLNNFYPKDINVKWKIDGSERQNGVLNSWTDQDSKDSTYSMSSTLTLTKDEYERHNSYTXEATHKTSTSPIVKSFNRNEX

SEQ ID NO: 1098 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSSLSASVGDRVTITXSASSSVSYMNWYQQTPGKAPKRWIYDTSKLASGVPSRFSGSGSGTDYTFTISSLQPEDIATYYXQQWSSNPFTFGQGTKLQITRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1099 - protein, 215 aa, Artificial Sequence
  Synthesized sequence with two or more selenocysteine residues substituted for two or more cysteine residues
  VARIANT (1)...(215): Xaa = selenocysteine or cysteine
EIVLTQSPATLSLSPGERATLSXRASQSVSSYLAWYQQKPGQAPRLLIYDASKRATGIPARFSGSGSGTDFTLTISSLEPEDFAVYYXQQRSKWPPWTFGQGTKVESKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1100 - protein, 214 aa, Artificial Sequence
  Synthesized sequence with two or more selenocysteine residues substituted for two or more cysteine residues
  VARIANT (1)...(214): Xaa = selenocysteine or cysteine
SYELTQPLSVSVALGQTARITXSGDSIPNYYVYWYQQKPGQAPVLVIYDDSNRPSGIPERFSGSNSGNTATLTISRAQAGDEADYYXQSFDSSLNAEVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 1101 - protein, 214 aa, Artificial Sequence
  Synthesized sequence with two or more selenocysteine residues substituted for two or more cysteine residues
  VARIANT (1)...(214): Xaa = selenocysteine or cysteine
SYVLTQPPSVSVAPGQTARITXGGNNLGSKSVHWYQQKPGQAPVLVVYDDSDRPSWIPERFSGSNSGNTATLTISRGEAGDEADYYXQVWDSSSDHVVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 1102 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSSLSASVGDRVTITXKASQDVGTAVAWYQQKPGKAPKLLIYWASTRHTGVPSRFSGSGSGTDFTLTISSLQPEDFATYYXQQYSSYRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1103 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRTSENIYSYLAWYQQKPGKAPKLLIYNAKTLAEGVPSRFSGSGSGTDFTLTISSLQPEDFATYYXQHHYGIPFTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1104 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPPSLSASAGDRVTITXRASQGISSRLAWYQQKPEKAPKSLIYAASSLQSGVPSRFSGSGSGTDFTLTISSLQPEDFATYYXQQYNSYPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1105 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQDISSYLNWYQQKPGKAPKLLIYYTSRLHSGVPSRFSGSGSGTDFTFTISSLQPEDIATYYXQQGNTLPYTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1106 - protein, 215 aa, Artificial Sequence
  Synthesized sequence with two or more selenocysteine residues substituted for two or more cysteine residues
  VARIANT (1)...(215): Xaa = selenocysteine or cysteine
DIQMTQSPSSLSASVGDRVSITXRPSQSFSRYINWYQQKPGKAPKLLIHAASSLVGGVPSRFSGSGSGTDFTLTISSLQPEDFATYYXQQTYSNPPITFGQGTRLEMKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1107 - protein, 214 aa, Artificial Sequence
  Synthesized sequence with two or more selenocysteine residues substituted for two or more cysteine residues
  VARIANT (1)...(214): Xaa = selenocysteine or cysteine
SYVLTQPPSVSVAPGKTARITXGGNIIGSKLVHWYQQKPGQAPVLVIYDDGDRPSGIPERFSGSNSGNTATLTISRVEAGDEADYYXQVWDTGSDPVVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 1108 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQDVNTAVAWYQQKPGKAPKLLIYSASFLYSGVPSRFSGSRSGTDFTLTISSLQPEDFATYYXQQHYTTPPTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1109 - protein, 214 aa, Artificial Sequence; identical to SEQ ID NO: 1108
  Synthesized sequence with two or more selenocysteine residues substituted for two or more cysteine residues
  VARIANT (1)...(214): Xaa = selenocysteine or cysteine

SEQ ID NO: 1110 - protein, 218 aa, Artificial Sequence
  Synthesized sequence with two or more selenocysteine residues substituted for two or more cysteine residues
  VARIANT (1)...(218): Xaa = selenocysteine or cysteine
DIVMTQSPDSLAVSLGERATINXRASKSVSTSGYSYIYWYQQKPGQPPKLLIYLASILESGVPDRFSGSGSGTDFTLTISSLQAEDVAVYYXQHSRELPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1111 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQSINSYLDWYQQKPGKAPKLLIYAASSLQSGVPSRFSGSGSGTDFTLTISSLQPEDFATYYXQQYYSTPFTFGPGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1112 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPASLSASVGDRVTITXRASQDISDYLAWYQQKPGKIPRLLIYTTSTLQSGVPSRFRGSGSGTDFTLTISSLQPEDVATYYXQKYDSAPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1113 - protein, 213 aa, Artificial Sequence
  Synthesized sequence with two or more selenocysteine residues substituted for two or more cysteine residues
  VARIANT (1)...(213): Xaa = selenocysteine or cysteine
QIVLSQSPAILSASPGEKVTMTXRASSSVSYMHWYQQKPGSSPKPWIYATSNLASGVPARFSGSGSGTSYSFTISRVEAEDAATYYXQQWTFNPPTFGGGTRLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1114 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQGISSWLAWYQQKPEKAPKSLIYAASSLQSGVPSRFSGSGSGTDFTLTISSLQPEDFVTYYXQQYNSYPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1115 - protein, 216 aa, Artificial Sequence
  Synthesized sequence with two or more selenocysteine residues substituted for two or more cysteine residues
  VARIANT (1)...(216): Xaa = selenocysteine or cysteine
EIVLTQSPATLSLSPGERATLSXRASQSVSSYLAWYQQKPGQAPRLLIYDASNRATGIPARFSGSGSGTDFTLTISSLEPEDFAVYYXQQRSNWPPALTFXGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1116 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQGISSWLAWYQQKPEKAPKSLIYAASSLQSGVPSRFSGSGSGTDFTLTISSLQPEDFATYYXQQYNIYPYTFGQGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1117 - protein, 214 aa, Artificial Sequence
  Synthesized sequence with two or more selenocysteine residues substituted for two or more cysteine residues
  VARIANT (1)...(214): Xaa = selenocysteine or cysteine
SYELTQPPSVSVSPGQTASITXSGDNIGDQYAHWYQQKPGQSPVLVIYQDKNRPSGIPERFSGSNSGNTATLTISGTQAMDEADYYXATYTGFGSLAVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 1118 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTINXKASQDINSYLSWFQQKPGKAPKTLIYRANRLVDGVPSRFSGSGSGQDYTLTISSLQPEDFATYYXLQYDEFPLTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1119 - protein, 220 aa, Artificial Sequence
  Synthesized sequence with two or more selenocysteine residues substituted for two or more cysteine residues
  VARIANT (1)...(220): Xaa = selenocysteine or cysteine
DIQMTQSPSSLSASVGDRVTITXKSSQSLLYRSNQKNYLAWYQQKPGKAPKLLIYWASTRESGVPSRFSGSGSGTDFTLTISSLQPEDFATYYXQQYYNYPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1120 - protein, 213 aa, Artificial Sequence
  Synthesized sequence with two or more selenocysteine residues substituted for two or more cysteine residues
  VARIANT (1)...(213): Xaa = selenocysteine or cysteine
DIELTQPPSVSVAPGQTARISXSGDNIGSFYVHWYQQKPGQAPVLVIYDKSNRPSGIPERFSGSNSGNTATLTISGTQAEDEADYYXQSYANTLSLVFGGGTKLTVLGQPKAAPSVTLFPPSSEELQANKATLVXLISDFYPGAVTVAWKADSSPVKAGVETTTPSKQSNNKYAASSYLSLTPEQWKSHRSYSXQVTHEGSTVEKTVAPTEXS

SEQ ID NO: 1121 - protein, 213 aa, Artificial Sequence
  Synthesized sequence with two or more selenocysteine residues substituted for two or more cysteine residues
  VARIANT (1)...(213): Xaa = selenocysteine or cysteine
QPGLTQPPSVSVAPGQTARITXGGNNIGSKSVHWYQQKPGQAPVLVVYDDSDRPSGIPERFSGSNSGNTATLTISRVEAGDEADYYXQVWDSSSDHYVFGTGTKVTVLSSASTKGPSVFPLAPSSKSTSGGTAALGXLVKDYFPEPVTVSWNSGALTSGVHTFPAVLQSSGLYSLSSVVTVPSSSLGTQTYIXNVNHKPSNTKVDKKVEPKSX

SEQ ID NO: 1122 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQGISRWLAWYQQKPEKAPKSLIYAASSLQSGVPSRFSGSGSGTDFTLTISSLQPEDFATYYXQQYNTYPRTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1123 - protein, 213 aa, Artificial Sequence
  Synthesized sequence with two or more selenocysteine residues substituted for two or more cysteine residues
  VARIANT (1)...(213): Xaa = selenocysteine or cysteine
DFVMTQSPAFLSVTPGEKVTITXSAQSSVNYIHWYQQKPDQAPKKLIYDTSKLASGVPSRFSGSGSGTDYTFTISSLEAEDAATYYXQQWTTNPLTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1124 - protein, 219 aa, Artificial Sequence
  Synthesized sequence with two or more selenocysteine residues substituted for two or more cysteine residues
  VARIANT (1)...(219): Xaa = selenocysteine or cysteine
DVVMTQSPLSLPVTPGEPASISXRSSQSLAKSYGNTYLSWYLQKPGQSPQLLIYGISNRFSGVPDRFSGSGSGTDFTLKISRVEAEDVGVYYXLQGTHQPYTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1125 - protein, 213 aa, Artificial Sequence
  Synthesized sequence with two or more selenocysteine residues substituted for two or more cysteine residues
  VARIANT (1)...(213): Xaa = selenocysteine or cysteine
DIQLTQSPSSLSASVGDRVTMTXRASSSVSYIHWFQQKPGKAPKPWIYATSNLASGVPVRFSGSGSGTDYTFTISSLQPEDIATYYXQQWTSNPPTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1126 - protein, 214 aa, Artificial Sequence
  Synthesized sequence with two or more selenocysteine residues substituted for two or more cysteine residues
  VARIANT (1)...(214): Xaa = selenocysteine or cysteine
DIQMTQSPSSLSASVGDRVTITXRASQYFSSYLAWYQQKPGKAPKLLIYGASSRASGVPSRFSGSGSGTDFTLTISSLQPEDFATYYXQQYLGSPPTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1127 - protein, 213 aa, Artificial Sequence
  Synthesized sequence with two or more selenocysteine residues substituted for two or more cysteine residues
  VARIANT (1)...(213): Xaa = selenocysteine or cysteine
DIQMTQSPSSLSASVGDRVTITXSASSSVSYMNWYQQKPGKAPKRLIYDTSKLASGVPSRFSGSGSGTDFTLTISSLQPEDFATYYXQQWSSNPPTFGGGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1128 - protein, 215 aa, Artificial Sequence
  Synthesized sequence with two or more selenocysteine residues substituted for two or more cysteine residues
  VARIANT (1)...(215): Xaa = selenocysteine or cysteine
QIVLTQSPAIMSASLGERVTMTXTASSSVSSNYLHWYQQKPGSAPNLWIYSTSNLASGVPARFSGSGSGTSYSLTISSMEAEDAATYYXHQYLRSPPTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1129 - protein, 218 aa, Artificial Sequence
  Synthesized sequence with two or more selenocysteine residues substituted for two or more cysteine residues
  VARIANT (1)...(218): Xaa = selenocysteine or cysteine
DIVMTQSPDSLAVSLGERATINXRASKSVSTSGYSFMHWYQQKPGQPPKLLIYLASNLESGVPDRFSGSGSGTDFTLTISSLQAEDVAVYYXQHSREVPWTFGQGTKVEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1130 - protein, 216 aa, Artificial Sequence; identical to SEQ ID NO: 949
  Synthesized sequence with two or more selenocysteine residues substituted for two or more cysteine residues
  VARIANT (1)...(216): Xaa = selenocysteine or cysteine

SEQ ID NO: 1131 - protein, 219 aa, Artificial Sequence
  Synthesized sequence with two or more selenocysteine residues substituted for two or more cysteine residues
  VARIANT (1)...(219): Xaa = selenocysteine or cysteine
DIVMTQAAFSNPVTLGTSASISXRSSKSLLHSNGITYLYWYLQKPGQSPQLLIYQMSNLASGVPDRFSSSGSGTDFTLRISRVEAEDVGVYYXAQNLELPYTFGGGTKLEIKRTVAAPSVFIFPPSDEQLKSGTASVVXLLNNFYPREAKVQWKVDNALQSGNSQESVTEQDSKDSTYSLSSTLTLSKADYEKHKVYAXEVTHQGLSSPVTKSFNRGEX

SEQ ID NO: 1132 - protein, 192 aa, Artificial Sequence
  Synthesized sequence with two or more selenocysteine residues substituted for two or more cysteine residues
  VARIANT (1)...(192): Xaa = selenocysteine or cysteine
MFPTIPLSRLFDNAMLRAHRLHQLAFDTYQEFEEAYIPKEQKYSFLQNPQTSLXFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYXFRKDMDKVETFLRIVQXRSVEGSXGF

SEQ ID NO: 1133 - protein, 217 aa, Artificial Sequence
  Synthesized sequence with two or more selenocysteine residues substituted for two or more cysteine residues
  VARIANT (1)...(217): Xaa = selenocysteine or cysteine
MATGSRTSLLLAFGLLCLPWLQEGSAFPTIPLSRLFDNAMLRAHRLHQLAFDTYQEFEEAYIPKEQKYSFLQNPQTSLXFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYXFRKDMDKVETFLRIVQXRSVEGSXGF

SEQ ID NO: 1134 - protein, 147 aa, Artificial Sequence
  Synthesized sequence with two or more selenocysteine residues substituted for two or more cysteine residues
  VARIANT (1)...(147): Xaa = selenocysteine or cysteine
MVPIQKVQDDTKTLIKTIVTRINDISHTQSVSSKQKVTGLDFIPGLHPILTLSKMDQTLAVYQQILTSMPSRNVIQISNDLENLRDLLHVLAFSKSXHLPWASGLETLDSLGGVLEASGYSTEVVALSRLQGSLQDMLWQLDLSPGX

SEQ ID NO: 1135 - protein, 167 aa, Artificial Sequence
  Synthesized sequence with two or more selenocysteine residues substituted for two or more cysteine residues
  VARIANT (1)...(167): Xaa = selenocysteine or cysteine
MAPPRLIXDSRVLERYLLEAKEAENITTGXAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGDR

SEQ ID NO: 1136 - protein, 166 aa, Artificial Sequence
  Synthesized sequence with two or more selenocysteine residues substituted for two or more cysteine residues
  VARIANT (1)...(166): Xaa = selenocysteine or cysteine
APPRLIXDSRVLERYLLEAKEAENITTGXAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGDR

SEQ ID NO: 1137 - protein, 166 aa, Artificial Sequence; identical to SEQ ID NO: 1136
  Synthesized sequence with two or more selenocysteine residues substituted for two or more cysteine residues
  VARIANT (1)...(166): Xaa = selenocysteine or cysteine

SEQ ID NO: 1138 - protein, 165 aa, Artificial Sequence
  Synthesized sequence with two or more selenocysteine residues substituted for two or more cysteine residues
  VARIANT (1)...(165): Xaa = selenocysteine or cysteine
APPRLIXDSRVLERYLLEAKEAENITTGXAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGD

SEQ ID NO: 1139 - protein, 407 aa, Artificial Sequence
  Synthesized sequence with two or more selenocysteine residues substituted for two or more cysteine residues
  VARIANT (1)...(407): Xaa = selenocysteine or cysteine
MVLAAPLLLGFLLLALELRPRGEAAEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRXCRYPLTVDFEAFGWDWIIAPKRYKANYXSGQXEYMFMQKYPHTHLVQQANPRGSAGPXXTPTKMSPINMLYFNDKQQIIYGKIPGMVVDRXGXS

SEQ ID NO: 1140 - protein, 140 aa, Artificial Sequence
  Synthesized sequence with two or more selenocysteine residues substituted for two or more cysteine residues
  VARIANT (1)...(140): Xaa = selenocysteine or cysteine
MNLPPGNYKKPKLLYCSNGGHFLRILPDGTVDGTRDRSDQHIQLQLSAESVGEVYIKSTETGQYLXMDTDGLLYGSQTPNEEXLFLERLEENHYNTYISKKHAEKNWFVGLKKNGSCKRGPRTHYGQKAILFLPLPVSSD

SEQ ID NO: 1141 - protein, 146 aa, Artificial Sequence
  Synthesized sequence with two or more selenocysteine residues substituted for two or more cysteine residues
  VARIANT (1)...(146): Xaa = selenocysteine or cysteine
MALPEDGGSGAFPPGHFKDPKRLYCKNGGFFLRIHPDGRVDGVREKSDPHIKLQLQAEERGVVSIKGVSANRYLAMKEDGXLLASKSVTDECFFFERLEXNNYNTYRSRKYTSWYVALKRTGQYKLGSKTGPGQKAILFLPMSAKS

SEQ ID NO: 1142 - protein, 21 aa, Artificial Sequence
  Synthesized sequence with two or more selenocysteine residues substituted for two or more cysteine residues
  VARIANT (1)...(21): Xaa = selenocysteine or cysteine
GIVEQXXTSIXSLYQLENYXG

SEQ ID NO: 1143 - protein, 32 aa, Artificial Sequence
  Synthesized sequence with two or more selenocysteine residues substituted for two or more cysteine residues
  VARIANT (1)...(32): Xaa = selenocysteine or cysteine
FVNQHLXGSHLVEALYLVXGERGFFYTPKTRR

SEQ ID NO: 1144 - protein, 21 aa, Artificial Sequence
  Synthesized sequence with two or more selenocysteine residues substituted for two or more cysteine residues
  VARIANT (1)...(21): Xaa = selenocysteine or cysteine
GIVEQXXTSIXSLYQLENYXN

SEQ ID NO: 1145 - protein, 30 aa, Artificial Sequence
  Synthesized sequence with two or more selenocysteine residues substituted for two or more cysteine residues
  VARIANT (1)...(30): Xaa = selenocysteine or cysteine
FVNQHLXGSHLVEALYLVXGERGFFYTDKT

SEQ ID NO: 1146 - protein, 21 aa, Artificial Sequence
  Synthesized sequence with two or more selenocysteine residues substituted for two or more cysteine residues
  VARIANT (1)...(21): Xaa = selenocysteine or cysteine
GIVEQXXTSIXSLYQLENYXN

SEQ ID NO: 1147 - protein, 30 aa, Artificial Sequence
  Synthesized sequence with two or more selenocysteine residues substituted for two or more cysteine residues
  VARIANT (1)...(30): Xaa = selenocysteine or cysteine
FVNQHLXGSHLVEALYLVXGERGFFYTKPT

SEQ ID NO: 1148 - protein, 21 aa, Artificial Sequence
  Synthesized sequence with two or more selenocysteine residues substituted for two or more cysteine residues
  VARIANT (1)...(21): Xaa = selenocysteine or cysteine
GIVEQXXTSIXSLYQLENYXN

SEQ ID NO: 1149 - protein, 30 aa, Artificial Sequence
  Synthesized sequence with two or more selenocysteine residues substituted for two or more cysteine residues
  VARIANT (1)...(30): Xaa = selenocysteine or cysteine
FVNQHLXGSHLVEALYLVXGERGFFYTPKT

SEQ ID NO: 1150 - protein, 21 aa, Artificial Sequence
  Synthesized sequence with two or more selenocysteine residues substituted for two or more cysteine residues
  VARIANT (1)...(21): Xaa = selenocysteine or cysteine
GIVEQXXTSIXSLYQLENYXN

SEQ ID NO: 1151 - protein, 29 aa, Artificial Sequence
  Synthesized sequence with two or more selenocysteine residues substituted for two or more cysteine residues
  VARIANT (1)...(29): Xaa = selenocysteine or cysteine
FVNQHLXGSHLVEALYLVXGERGFFYTPK

SEQ ID NO: 1152 - protein, 21 aa, Artificial Sequence
  Synthesized sequence with two or more selenocysteine residues substituted for two or more cysteine residues
  VARIANT (1)...(21): Xaa = selenocysteine or cysteine
GIVEQXXTSIXSLYQLENYXN

SEQ ID NO: 1153 - protein, 30 aa, Artificial Sequence
  Synthesized sequence with two or more selenocysteine residues substituted for two or more cysteine residues
  VARIANT (1)...(30): Xaa = selenocysteine or cysteine
FVKQHLXGSHLVEALYLVXGERGFFYTPET

SEQ ID NO: 1154 - protein, 21 aa, Artificial Sequence
  Synthesized sequence with two or more selenocysteine residues substituted for two or more cysteine residues
  VARIANT (1)...(21): Xaa = selenocysteine or cysteine
GIVEQXXTSIXSLYQLENYXN

SEQ ID NO: 1155 - protein, 29 aa, Artificial Sequence
  Synthesized sequence with two or more selenocysteine residues substituted for two or more cysteine residues
  VARIANT (1)...(29): Xaa = selenocysteine or cysteine
FVNQHLXGSHLVEALYLVXGERGFFYTPK

SEQ ID NO: 1156 - protein, 189 aa, Artificial Sequence
  Synthesized sequence with two or more selenocysteine residues substituted for two or more cysteine residues
  VARIANT (1)...(189): Xaa = selenocysteine or cysteine
MASPFALLMVLVVLSCKSSCSLGXDLPETHSLDNRRTLMLLAQMSRISPSSXLMDRHDFGFPQEEFDGNQFQKAPAISVLHELIQQIFNLFTTKDSSAAWDEDLLDKFCTELYQQLNDLEAXVMQEERVGETPLMNADSILAVKKYFRRITLYLTEKKYSPXAWEVVRAEIMRSLSLSTNLQERLRRKE

SEQ ID NO: 1157 - protein, 166 aa, Artificial Sequence
  Synthesized sequence with two or more selenocysteine residues substituted for two or more cysteine residues
  VARIANT (1)...(166): Xaa = selenocysteine or cysteine
XDLPETHSLDNRRTLMLLAQMSRISPSSXLMDRHDFGFPQEEFDGNQFQKAPAISVLHELIQQIFNLFTTKDSSAAWDEDLLDKFCTELYQQLNDLEAXVMQEERVGETPLMNADSILAVKKYFRRITLYLTEKKYSPXAWEVVRAEIMRSLSLSTNLQERLRRKE

SEQ ID NO: 1158 - protein, 165 aa, Artificial Sequence
  Synthesized sequence with two or more selenocysteine residues substituted for two or more cysteine residues
  VARIANT (1)...(165): Xaa = selenocysteine or cysteine
XDLPQTHSLGSRRTLMLLAQMRKISLFSXLKDRHDFGFPQEEFGNQFQKAETIPVLHEMIQQIFNLFSTKDSSAAWDETLLDKFYTELYQQLNDLEAXVIQGVGVTETPLMKEDSILAVRKYFQRITLYLKEKKYSPXAWEVVRAEIMRSFSLSTNLQESLRSKE

SEQ ID NO: 1159 - protein, 166 aa, Artificial Sequence
  Synthesized sequence with two or more selenocysteine residues substituted for two or more cysteine residues
  VARIANT (1)...(166): Xaa = selenocysteine or cysteine
XDLPQTHSLGNRRALILLAQMRRISPFSXLKDRHDFEFPQEEFDDKQFQKAQAISVLHEMIQQTFNLFSTKDSSAALDETLLDEFYIELDQQLNDLESXVMQEVGVIESPLMYEDSILAVRKYFQRITLYLTEKKYSSXAWEVVRAEIMRSFSLSINLQKRLKSKE

SEQ ID NO: 1160 - protein, 166 aa, Artificial Sequence
  Synthesized sequence with two or more selenocysteine residues substituted for two or more cysteine residues
  VARIANT (1)...(166): Xaa = selenocysteine or cysteine
XDLPQTHSLGNRRALILLGQMGRISPFSXLKDRHDFRIPQEEFDGNQFQKAQAISVLHEMIQQTFNLFSTEDSSAAWEQSLLEKFSTELYQQLNDLEAXVIQEVGVEETPLMNEDSILAVRKYFQRITLYLIERKYSPXAWEVVRAEIMRSLSFSTNLQKRLRRKD

SEQ ID NO: 1161 - protein, 166 aa, Artificial Sequence
  Synthesized sequence with two or more selenocysteine residues substituted for two or more cysteine residues
  VARIANT (1)...(166): Xaa = selenocysteine or cysteine
XNLSQTHSLNNRRTLMLMAQMRRISPFSXLKDRHDFEFPQEEFDGNQFQKAQAISVLHEMMQQTFNLFSTKNSSAAWDETLLEKFYIELFQQMNDLEAXVIQEVGVEETPLMNEDSILAVKKYFQRITLYLMEKKYSPXAWEVVRAEIMRSLSFSTNLQKRLRRKD

SEQ ID NO: 1162 - protein, 166 aa, Artificial Sequence
  Synthesized sequence with two or more selenocysteine residues substituted for two or more cysteine residues
  VARIANT (1)...(166): Xaa = selenocysteine or cysteine
XDLPQTHSLGNRRALILLAQMGRISPFSXLKDRHDFGFPQEEFDGNQFQKAQAISVLHEMIQQTFNLFSTKDSSATWEQSLLEKFSTELNQQLNDLEAXVIQEVGVEETPLMNVDSILAVKKYFQRITLYLTEKKYSPXAWEVVRAEIMRSFSLSKIFQERLRRKE

SEQ ID NO: 1163 - protein, 188 aa, Artificial Sequence
  Synthesized sequence with two or more selenocysteine residues substituted for two or more cysteine residues
  VARIANT (1)...(188): Xaa = selenocysteine or cysteine
MALTFALLVALLVLSCKSSCSVGXDLPQTHSLGSRRTLMLLAQMRKISLFSXLKDRHDFGFPQEEFGNQFQKAETIPVLHEMIQQIFNLFSTKDSSAAWDETLLDKFYTELYQQLNDLEAXVIQGVGVTETPLMKEDSILAVRKYFQRITLYLKEKKYSPXAWEVVRAEIMRSFSLSTNLQESLRSKE

SEQ ID NO: 1164 - protein, 165 aa, Artificial Sequence
  Synthesized sequence with two or more selenocysteine residues substituted for two or more cysteine residues
  VARIANT (1)...(165): Xaa = selenocysteine or cysteine
XDLPQTHSLGSRRTLMLLAQMRRISLFSXLKDRHDFGFPQEEFGNQFQKAETIPVLHEMIQQIFNLFSTKDSSAAWDETLLDKFYTELYQQLNDLEAXVIQGVGVTETPLMKEDSILAVRKYFQRITLYLKEKKYSPXAWEVVRAEIMRSFSLSTNLQESLRSKE

SEQ ID NO: 1165 - protein, 165 aa, Artificial Sequence; identical to SEQ ID NO: 1158
  Synthesized sequence with two or more selenocysteine residues substituted for two or more cysteine residues
  VARIANT (1)...(165): Xaa = selenocysteine or cysteine

SEQ ID NO: 1166 - protein, 165 aa, Artificial Sequence
  Synthesized sequence with two or more selenocysteine residues substituted for two or more cysteine residues
  VARIANT (1)...(165): Xaa = selenocysteine or cysteine
XDLPQTHSLGSRRTLMLLAQMRRISLFSXLKDRHDFGFPQEEFGNQFQKAETIPVLHEMIQQIFNLFSTKDSSAAWDETLLDKFYTELYQQLNDLEAXVIQGVGVTETPLMNEDSILAVRKYFQRITLYLKEKKYSPXAWEVVRAEIMRSFSLSTNLQESLRSKE

SEQ ID NO: 1167 - protein, 166 aa, Artificial Sequence
  Synthesized sequence with two or more selenocysteine residues substituted for two or more cysteine residues
  VARIANT (1)...(166): Xaa = selenocysteine or cysteine
MSYNLLGFLQRSSNFQCQKLLWQLNGRLEYXLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHXAWTIVRVEILRNFYFINRLTGYLRN

SEQ ID NO: 1168 - protein, 166 aa, Artificial Sequence; identical to SEQ ID NO: 1167
  Synthesized sequence with two or more selenocysteine residues substituted for two or more cysteine residues
  VARIANT (1)...(166): Xaa = selenocysteine or cysteine

SEQ ID NO: 1169 - protein, 166 aa, Artificial Sequence
  Synthesized sequence with two or more selenocysteine residues substituted for two or more cysteine residues
  VARIANT (1)...(166): Xaa = selenocysteine or cysteine
MSYNLLGFLQRSSNFQSQKLLWQLNGRLEYXLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHXAWTIVRVEILRNFYFINRLTGYLRN

SEQ ID NO: 1170 - protein, 165 aa, Artificial Sequence
  Synthesized sequence with two or more selenocysteine residues substituted for two or more cysteine residues
  VARIANT (1)...(165): Xaa = selenocysteine or cysteine
SYNLLGFLQRSSNFQSQKLLWQLNGRLEYXLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHXAWTIVRVEILRNFYFINRLTGYLRN

SEQ ID NO: 1171 - protein, 207 aa, Artificial Sequence
  Synthesized sequence with two or more selenocysteine residues substituted for two or more cysteine residues
  VARIANT (1)...(207): Xaa = selenocysteine or cysteine
MAGPATQSPMKLMALQLLLWHSALWTVQEATPLGPASSLPQSFLLKCLEQVRKIQGDGAALQEKLVSEXATYKLXHPEELVLLGHSLGIPWAPLSSXPSQALQLAGXLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1172 - protein, 175 aa, Artificial Sequence
  Synthesized sequence with two or more selenocysteine residues substituted for two or more cysteine residues
  VARIANT (1)...(175): Xaa = selenocysteine or cysteine
MTPLGPASSLPQSFLLKCLEQVRKIQGDGAALQEKLXATYKLXHPEELVLLGHSLGIPWAPLSSXPSQALQLAGXLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1173 - protein, 127 aa, Artificial Sequence
  Synthesized sequence with two or more selenocysteine residues substituted for two or more cysteine residues
  VARIANT (1)...(127): Xaa = selenocysteine or cysteine
APARSPSPSTQPWEHVNAIQEALRLLNLSRDTAAEMNETVEVISEMFDLQEPTXLQTRLELYKQGLRGSLTKLKGPLTMMASHYKQHXPPTPETSXATQIITFESFKENLKDFLLVIPFDXWEPVQE

SEQ ID NO: 1174 - protein, 648 aa, Artificial Sequence
  Synthesized sequence with two or more selenocysteine residues substituted for two or more cysteine residues
  VARIANT (1)...(648): Xaa = selenocysteine or cysteine
MHHHHHHDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELKRATPSHNSHQVPSAGGPTANSGTSGSEVQLVQSGPGLVQPGGSVRISXAASGYTFTNYGMNWVKQAPGKGLEWMGWINTYTGESTYADSFKGRFTFSLDTSASAAYLQINSLRAEDTAVYYXARFAIKGDYWGQGTLLTVSSEFGGAPEFPKPSTPPGSSGLEGGSLAALTAHQAXHLPLETFTRHRQPRGWEQLEQXGYPVQRLVALYLAARLSWNQVDQVIRNALASPGSGGDLGEAIREQPEQARLALTLAAAESERFVRQGTGNDEAGAASADVVSLTCPVAAGECAGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTGLTLAAPEAAGEVERLIGHPLPLRLDAITGPEEEGGRLETILGWPLAERTVVIPSAIPTDPRNVGGDLDPSSIPDKEQAISALPDYASQPGKPPHHHHHHKDEL

SEQ ID NO: 1175 - protein, 467 aa, Artificial Sequence
  Synthesized sequence with two or more selenocysteine residues substituted for two or more cysteine residues
  VARIANT (1)...(467): Xaa = selenocysteine or cysteine
LPAQVAFTPYAPEPGSTXRLREYYDQTAQMXXSKXSPGQHAKVFXTKTSDTVXDSXEDSTYTQLWNWVPEXLSXGSRXSSDQVETQAXTREQNRIXTXRPGWYXALSKQEGXRLXAPLRKXRPGFGVARPGTETSDVVXKPXAPGTFSNTTSSTDIXRPHQICNVVAIPGNASMDAVCTSTSPTRSMAPGAVHLPQPVSTRSQHTQPTPEPSTAPSTSFLLPMGPSPPAEGSTGDEPKSXDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1176 - protein, 139 aa, Artificial Sequence
  Synthesized sequence with two or more selenocysteine residues substituted for two or more cysteine residues
  VARIANT (1)...(139): Xaa = selenocysteine or cysteine
ANSFLEEMKKGHLEREXMEETXSYEEAREVFEDSDKTNEFWNKYKDGDQXETSPXQNQGKXKDGLGEYTXTXLEGFEGKNXELFTRKLXSLDNGDXDQFXHEEQNSVVXSXARGYTLADNGKAXIPTGPYPXGKQTLER

SEQ ID NO: 1177 - protein, 306 aa, Artificial Sequence
  Synthesized sequence with two or more selenocysteine residues substituted for two or more cysteine residues
  VARIANT (1)...(306): Xaa = selenocysteine or cysteine
SVAQATSSSGEAPDSITWKPYDAADLDPTENPFDLLDFNQTQPERGDNNLTRIVGGQEXKDGEXPWQALLINEENEGFXGGTILSEFYILTAAHXLYQAKRFKVRVGDRNTEQEEGGEAVHEVEVVIKHNRFTKETYDFDIAVLRLKTPITFRMNVAPAXLPERDWAESTLMTQKTGIVSGFGRTHEKGRQSTRLKMLEVPYVDRNSXKLSSSFIITQNMFXAGYDTKQEDAXQGDSGGPHVTRFKDTYFVTGIVSWGEGXARKGKYGIYTKVTAFLKWIDRSMKTRGLPKAKSHAPEVITSSPLK

SEQ ID NO: 1178 - protein, 1313 aa, Artificial Sequence
  Synthesized sequence with two or more selenocysteine residues substituted for two or more cysteine residues
  VARIANT (1)...(1313): Xaa = selenocysteine or cysteine
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLXLTYSYLSHVDLVKDLNSGLIGALLVXREGSLAKEKTQTLHKFILLFAVFDEGKSWHSETKNSLMQDRDAASARAWPKMHTVNGYVNRSLPGLIGXHRKSVYWHVIGMGTTPEVHSIFLEGHTFLVRNHRQASLEISPITFLTAQTLLMDLGQFLLFCHISSHQHDGMEAYVKVDSXPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRXLTRYYSSFVNMERDLASGLIGPLLIXYKESVDQRGNQIMSDKRNVILFSVFDENRSWYLTENIQRFLPNPAGVQLEDPEFQASNIMHSINGYVFDSLQLSVXLHEVAYWYILSIGAQTDFLSVFFSGYTFKHKMVYEDTLTLFPFSGETVFMSMENPGLWILGCHNSDFRNRGMTALLKVSSXDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKR

SEQ ID NO: 1179 - protein, 684 aa, Artificial Sequence
  Synthesized sequence with two or more selenocysteine residues substituted for two or more cysteine residues
  VARIANT (1)...(684): Xaa = selenocysteine or cysteine
EITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDXKAWAYFSDVDLEKDVHSGLIGPLLVXHTNTLNPAHGRQVTVQEFALFFTIFDETKSWYFTENMERNXRAPXNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKXQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGXDLNSXSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGXEAQDLY

SEQ ID NO: 1180 - protein, 2332 aa, Artificial Sequence
  Synthesized sequence with two or more selenocysteine residues substituted for two or more cysteine residues
  VARIANT (1)...(2332): Xaa = selenocysteine or cysteine
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLXLTYSYLSHVDLVKDLNSGLIGALLVXREGSLAKEKTQTLHKFILLFAVFDEGKSWHSETKNSLMQDRDAASARAWPKMHTVNGYVNRSLPGLIGXHRKSVYWHVIGMGTTPEVHSIFLEGHTFLVRNHRQASLEISPITFLTAQTLLMDLGQFLLFCHISSHQHDGMEAYVKVDSXPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRXLTRYYSSFVNMERDLASGLIGPLLIXYKESVDQRGNQIMSDKRNVILFSVFDENRSWYLTENIQRFLPNPAGVQLEDPEFQASNIMHSINGYVFDSLQLSVXLHEVAYWYILSIGAQTDFLSVFFSGYTFKHKMVYEDTLTLFPFSGETVFMSMENPGLWILGCHNSDFRNRGMTALLKVSSXDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDXKAWAYFSDVDLEKDVHSGLIGPLLVXHTNTLNPAHGRQVTVQEFALFFTIFDETKSWYFTENMERNXRAPXNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKXQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGXDLNSXSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGXEAQDLY

SEQ ID NO: 1181 - protein, 406 aa, Artificial Sequence
  Synthesized sequence with two or more selenocysteine residues substituted for two or more cysteine residues
  VARIANT (1)...(406): Xaa = selenocysteine or cysteine
ANAFLEELRPGSLEREXKEEQXSFEEAREIFKDAERTKLFWISYSDGDQXASSPXQNGGSXKDQLQSYIXFXLPAFEGRNXETHKDDQLIXVNENGGXEQYXSDHTGTKRSXRXHEGYSLLADGVSXTPTVEYPXGKIPILEKRNASKPQGRIVGGKVXPKGEXPWQVLLLVNGAQLXGGTLINTIWVVSAAHXFDKIKNWRNLIAVLGEHDLSEHDGDEQSRRVAQVIIPSTYVPGTTNHDIALLRLHQPVVLTDHVVPLXLPERTFSERTLAFVRFSLVSGWGQLLDRGATALELMVLNVPRLMTQDXLQQSRKVGDSPNITEYMFXAGYSDGSKDSXKGDSGGPHATHYRGTWYLTGIVSWGQGXATVGHFGVYTRVSQYIEWLQKLMRSEPRPGVLLRAPFP

SEQ ID NO: 1182 - protein, 276 aa, Artificial Sequence
  Synthesized sequence with two or more selenocysteine residues substituted for two or more cysteine residues
  VARIANT (1)...(276): Xaa = selenocysteine or cysteine
KPSSPPEELKFQXGQKTLRPRFKIIGGEFTTIENQPWFAAIYRRHRGGSVTYVXGGSLMSPXWVISATHXFIDYPKKEDYIVYLGRSRLNSNTQGEMKFEVENLILHKDYSADTLAHHNDIALLKIRSKEGRXAQPSRTIQTIXLPSMYNDPQFGTSXEITGFGKENSTDYLYPEQLKMTVVKLISHREXQQPHYYGSEVTTKMLXAADPQWKTDSXQGDSGGPLVXSLQGRMTLTGIVSWGRGXALKDKPGVYTRVSHFLPWIRSHTKEENGLAL

SEQ ID NO: 1183 - protein, 461 aa, Artificial Sequence
  Synthesized sequence with two or more selenocysteine residues substituted for two or more cysteine residues
  VARIANT (1)...(461): Xaa = selenocysteine or cysteine
MQRVNMIMAESPGLITICLLGYLLSAECTVFLDHENANKILNRPKRYNSGKLEEFVQGNLEREXMEEKXSFEEAREVFENTERTTEFWKQYVDGDQXESNPXLNGGSXKDDINSYEXWXPFGFEGKNXELDVTXNIKNGRXEQFXKNSADNKVVXSXTEGYRLAENQKSXEPAVPFPXGRVSVSQTSKLTRAETVFPDVDYVNSTEAETILDNITQSTQSFNDFTRVVGGEDAKPGQFPWQVVLNGKVDAFXGGSIVNEKWIVTAAHXVETGVKITVVAGEHNIEETEHTEQKRNVIRIIPHHNYNAAINKYNHDIALLELDEPLVLNSYVTPIXIADKEYTNIFLKFGSGYVSGWGRVFHKGRSALVLQYLRVPLVDRATXLRSTKFTIYNNMFXAGFHEGGRDSXQGDSGGPHVTEVEGTSFLTGIISWGEEXAMKGKYGIYTKVSRYVNWIKEKTKLT

SEQ ID NO: 1184 - protein, 415 aa, Artificial Sequence
  Synthesized sequence with two or more selenocysteine residues substituted for two or more cysteine residues
  VARIANT (1)...(415): Xaa = selenocysteine or cysteine
YNSGKLEEFVQGNLEREXMEEKXSFEEAREVFENTERTTEFWKQYVDGDQXESNPXLNGGSXKDDINSYEXWXPFGFEGKNXELDVTXNIKNGRXEQFXKNSADNKVVXSXTEGYRLAENQKSXEPAVPFPXGRVSVSQTSKLTRAEAVFPDVDYVNSTEAETILDNITQSTQSFNDFTRVVGGEDAKPGQFPWQVVLNGKVDAFXGGSIVNEKWIVTAAHXVETGVKITVVAGEHNIEETEHTEQKRNVIRIIPHHNYNAAINKYNHDIALLELDEPLVLNSYVTPIXIADKEYTNIFLKFGSGYVSGWGRVFHKGRSALVLQYLRVPLVDRATXLRSTKFTIYNNMFXAGFHEGGRDSXQGDSGGPHVTEVEGTSFLTGIISWGEEXAMKGKYGIYTKVSRYVNWIKEKTKLT

SEQ ID NO: 1185 - protein, 866 aa, Artificial Sequence
  Synthesized sequence with two or more selenocysteine residues substituted for two or more cysteine residues
  VARIANT (1)...(866): Xaa = selenocysteine or cysteine
MFSMRIVCLVLSVVGTAWTADSGEGDFLAEGGGVRGPRVVERHQSAXKDSDWPFXSDEDWNYKXPSGXRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSXRGSXSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSXSKTVTKTVIGPDGHKEVTKEVVTSEDGSDXPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRDCDDVLQTHPSGTQSGIFNIKLPGSSKIFSVYCDQETSLGGWLLIQQRMDGSLNFNRTWQDYKRGFGSLNDEGEGEFWLGNDYLHLLTQRGSVLRVELEDWAGNEAYAEYHFRVGSEAEGYALQVSSYEGTAGDALIEGSVEEGAEYTSHNNMQFSTFDRDADQWEENXAEVYGGGWWYNNXQAANLNGIYYPGGSYDPRNNSPYEIENGVVWVSFRGADYSLRAVRMKIRPLVTQ

SEQ ID NO: 1186 - protein, 491 aa, Artificial Sequence
  Synthesized sequence with two or more selenocysteine residues substituted for two or more cysteine residues
  VARIANT (1)...(491): Xaa = selenocysteine or cysteine
MKRMVSWSFHKLKTMKHLLLLLLCVFLVKSQGVNDNEEGFFSARGHRPLDKKREEAPSLRPAPPPISGGGYRARPAKAAATQKKVERKAPDAGGXLHADPDLGVLXPTGXQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYXRTPXTVSXNIPVVSGKEXEEIIRKGGETSEMYLIQPDSSVKPYRVYXDMNTENGGWTVIQNRQDGSVDFGRKWDPYKQGFGNVATNTDGKNYXGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQXSKEDGGGWWYNRXHAANPNGRYYWGGQYTWDMAKHGTDDGVVWMNWKGSWYSMRKMSMKIRPFFPQQ

SEQ ID NO: 1187 - protein, 453 aa, Artificial Sequence
  Synthesized sequence with two or more selenocysteine residues substituted for two or more cysteine residues
  VARIANT (1)...(453): Xaa = selenocysteine or cysteine
MSWSLHPRNLILYFYALLFLSSTCVAYVATRDNCCILDERFGSYXPTTXGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQXQEPXKDTVQIHDITGKDXQDIANKGAKQSGLYFIKPLKANQQFLVYXEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNXAEQDGSGWWMNKXHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 1188 - protein, 2813 aa, Artificial Sequence
  Synthesized sequence with two or more selenocysteine residues substituted for two or more cysteine residues
  VARIANT (1)...(2813): Xaa = selenocysteine or cysteine
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSXRPPMVKLVXPADNLRAEGLECTKTCQNYDLECMSMGXVSGXLXPPGMVRHENRXVALERCPCFHQGKEYAPGETVKIGCNTCVCQDRKWNCTDHVCDATXSTIGMAHYLTFDGLKYLFPGEXQYVLVQDYXGSNPGTFRILVGNKGXSHPSVKXKKRVTILVEGGEIELFDGEVNVKRPMKDETHFEVVESGRYIILLLGKALSVVWDRHLSISVVLKQTYQEKVXGLXGNFDGIQNNDLTSSNLQVEEDPVDFGNSWKVSSQXADTRKVPLDSSPATCHNNIMKQTMVDSSXRILTSDVFQDXNKLVDPEPYLDVXIYDTXSXESIGDCACFCDTIAAYAHVXAQHGKVVTWRTATLXPQSXEERNLRENGYECEWRYNSXAPAXQVTCQHPEPLAXPVQXVEGCHAHCPPGKILDELLQTCVDPEDXPVXEVAGRRFASGKKVTLNPSDPEHCQICHCDVVNLTXEAXQEPGGLVVPPTDAPVSPTTLYVEDISEPPLHDFYXSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLXDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRXXSGEGLQIPTLSPAPDXSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLXSGFVRIXMDEDGNEKRPGDVWTLPDQXHTVTXQPDGQTLLKSHRVNCDRGLRPSXPNSQSPVKVEETXGCRWTCPCVXTGSSTRHIVTFDGQNFKLTGSXSYVLFQNKEQDLEVILHNGAXSPGARQGXMKSIEVKHSALSVELHSDMEVTVNGRLVSVPYVGGNMEVNVYGAIMHEVRFNHLGHIFTFTPQNNEFQLQLSPKTFASKTYGLXGIXDENGANDFMLRDGTVTTDWKTLVQEWTVQRPGQTXQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPEXNDITARLQYVKVGSXKSEVEVDIHYXQGKXASKAMYSIDINDVQDQCSCXSPTRTEPMQVALHXTNGSVVYHEVLNAMEXKXSPRKCSK

SEQ ID NO: 1189 - protein, 522 aa, Artificial Sequence
  Synthesized sequence with two or more selenocysteine residues substituted for two or more cysteine residues
  VARIANT (1)...(522): Xaa = selenocysteine or cysteine
MAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLXGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFXPGQNVSGVTTHNLEDHTKLPLIFHLGRDPGERFPLSFASAEYQEALSRITSVVQQHQEALVPAQPQLNVXNWAVMNWAPPGXEKLGKXLTPPESIPKKXLWSH

SEQ ID NO: 1190 - protein, 496 aa, Artificial Sequence
  Synthesized sequence with two or more selenocysteine residues substituted for two or more cysteine residues
  VARIANT (1)...(496): Xaa = selenocysteine or cysteine
APQPPNILLLLMDDMGWGDLGVYGEPSRETPLCSPSRAALLTGRLPIRNGFYTTNAHARNLLKKAGYVSKIVGKWHLGHRPQFHPLKHGFNIPVYRDWEMVGRYYEEFPINLKTGEANLTFLYWAVDATHAPVYASKPFLGTSQRGRYGDVADNTFVFFTSDNGAALISAPEQGGSNGPFPGHVTAGQVSHQLGSIMDLFTTSLALAGLTLMDRPIFYYRGDTLMAATLGQHKAHFWTWTVTTHNLEDHTKLPLIFHLGRDPGERFPLSFEALVPAQPQLNVXNWAVMNWAPPGXEKLGKPNLDRMAAEGLLFPNFYSANAYTPQEIVGGIPDSEQLLPEDEWFGSPNCHFGPYDNKARPQIYLQEALDFIKRQARHHPFAVREIDDSIGKILELLQDLHLXGKQTTFEGGMREPALAWWPPSDRAIDGLNLLPTLLQGRNSWENFRQGIDFXPGQNVSGASAEYQEALSRITSVVQQHQXLTPPESIPKKXLWSH

SEQ ID NO: 1191 - protein, 645 aa, Artificial Sequence
  Synthesized sequence with two or more selenocysteine residues substituted for two or more cysteine residues
  VARIANT (1)...(645): Xaa = selenocysteine or cysteine
HGEGTFTSDVSSYLEGQAAKEFIAWLVKGRHGEGTFTSDVSSYLEGQAAKEFIAWLVKGRDAHKSEVAHRFKDLGEENFKALVLIAFAQYLQQCPFEDHVKLVNEVTEFAKTXVADESAENXDKSLHTLFGDKLXTVATLRETYGEMADXXAKQEPERNEXFLQHKDDNPNLPRLVRPEVDVMXTAFHDNEETFLKKYLYEIARRHPYFYAPELLFFAKRYKAAFTEXXQAADKAAXLLPKLDELRDEGKASSAKQRLKXASLQKFGERAFKAWAVARLSQRFPKAEFAEVSKLVTDLTKVHTEXXHGDLLEXADDRADLAKYIXENQDSISSKLKEXXEKPLLEKSHXIAEVENDEMPADLPSLAADFVESKDVXKNYAEAKDVFLGMFLYEYARRHPDYSVVLLLRLAKTYETTLEKXXAAADPHEXYAKVFDEFKPLVEEPQNLIKQNXELFEQLGEYKFQNALLVRYTKKVPQVSTPTLVEVSRNLGKVGSKXXKHPEAKRMPXAEDYLSVVLNQLXVLHEKTPVSDRVTKXXTESLVNRRPXFSALEVDETYVPKEFNAETFTFHADIXTLSEKERQIKKQTALVELVKHKPKATKEQLKAVMDDFAAFVEKXXKADDKETXFAEEGKKLVAASQAALGL

SEQ ID NO: 1192 - protein, 275 aa, Artificial Sequence
  Synthesized sequence with two or more selenocysteine residues substituted for two or more cysteine residues
  VARIANT (1)...(275): Xaa = selenocysteine or cysteine
HGEGTFTSDVSSYLEEQAAKEFIAWLVKGGGGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTXLVKGFYPSDIAVEWESNGQPENNYKTTPPVLDSDGSFFLYSRLTVDKSRWQEGNVFSXSVMHEALHNHYTQKSLSLSLG

SEQ ID NO: 1193 - protein, 524 aa, Artificial Sequence
  Synthesized sequence with two or more selenocysteine residues substituted for two or more cysteine residues
  VARIANT (1)...(524): Xaa = selenocysteine or cysteine
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRXNTTQGNEVTSILRWAKDAGKSVGIVTTTRVNHATPSAAYAHSADRDWYSDNEMPPEALSQGXKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAAXIGANLGHXAPASSAGSLAAGPLLLALALYPLSVLF

SEQ ID NO: 1194 - protein, 726 aa, Artificial Sequence
  Synthesized sequence with two or more selenocysteine residues substituted for two or more cysteine residues
  VARIANT (1)...(726): Xaa = selenocysteine or cysteine
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRXNTTQGNEVTSILRWAKDAGKSVGIVTTTRVNHATPSAAYAHSADRDWYSDNEMPPEALSQGXKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAAXIGANLGHXAPASSLKDKTHTXPPXPAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTLPPSREEMTKNQVSLTXLVKGFYPSDIAVEWESNGQPENNYKTTPPVLDSDGSFFLYSKLTVDKSRWQQGNVFSXSVMHEALHNHYTQKSLSLSPGKDIDDDDDDDDDD

SEQ ID NO: 1195 - protein, 116 aa, Artificial Sequence
  Synthesized sequence with two or more selenocysteine residues substituted for two or more cysteine residues
  VARIANT (1)...(116): Xaa = selenocysteine or cysteine
MDYYRKYAAIFLVTLSVFLHVLHSAPDVQDXPEXTLQENPFFSQPGAPILQXMGXXFSRAYPTPLRSKKTMLVQKNVTSESTXXVAKSYNRVTVMGGFKVENHTAXHXSTXYYHKS

SEQ ID NO: 1196 - protein, 129 aa, Artificial Sequence
  Synthesized sequence with two or more selenocysteine residues substituted for two or more cysteine residues
  VARIANT (1)...(129): Xaa = selenocysteine or cysteine
MKTLQFFFLFCCWKAICCNSXELTNITIAIEKEEXRFXISINTTWXAGYXYTRDLVYKDPARPKIQKTXTFKELVYETVRVPGXAHHADSLYTYPVATQXHXGKXDSDSTDXTVRGLGPSYXSFGEMKE

SEQ ID NO: 1197 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPEXTLQENPFFSQPGAPILQXMGXXFSRAYPTPLRSKKTMLVQKNVTSESTXXVAKSYNRVTVMGGFKVENHTAXHXSTXYYHKS

SEQ ID NO: 1198 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWXAGYXYTRDLVYKDPARPKIQKTXTFKELVYETVRVPGXAHHADSLYTYPVATQXHXGKXDSDSTDXTVRGLGPSYXSFGEMKE

SEQ ID NO: 1199 - protein, 92 aa, Artificial Sequence; identical to SEQ ID NO: 1197
  Synthesized sequence with two or more selenocysteine residues substituted for two or more cysteine residues
  VARIANT (1)...(92): Xaa = selenocysteine or cysteine

SEQ ID NO: 1200 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWXAGYXYTRDLVYKDPARPKIQKTXTPKELVYETVRVPGXAHHADSLYTYPVATQXHXGKXDSDSTDXTVRGLGPSYXSFGEMKE

SEQ ID NO: 1201 - protein, 609 aa, Artificial Sequence
  Synthesized sequence with two or more selenocysteine residues substituted for two or more cysteine residues
  VARIANT (1)...(609): Xaa = selenocysteine or cysteine
MKWVTFISLLFLFSSAYSRGVFRRDAHKSEVAHRFKDLGEENFKALVLIAFAQYLQQCPFEDHVKLVNEVTEFAKTXVADESAENXDKSLHTLFGDKLXTVATLRETYGEMADXXAKQEPERNEXFLQHKDDNPNLPRLVRPEVDVMXTAFHDNEETFLKKYLYEIARRHPYFYAPELLFFAKRYKAAFTEXXQAADKAAXLLPKLDELRDEGKASSAKQRLKXASLQKFGERAFKAWAVARLSQRFPKAEFAEVSKLVTDLTKVHTEXXHGDLLEXADDRADLAKYIXENQDSISSKLKEXXEKPLLEKSHXIAEVENDEMPADLPSLAADFVESKDVXKNYAEAKDVFLGMFLYEYARRHPDYSVVLLLRLAKTYETTLEKXXAAADPHEXYAKVFDEFKPLVEEPQNLIKQNXELFEQLGEYKFQNALLVRYTKKVPQVSTPTLVEVSRNLGKVGSKXXKHPEAKRMPXAEDYLSVVLNQLXVLHEKTPVSDRVTKXXTESLVNRRPXFSALEVDETYVPKEFNAETFTFHADIXTLSEKERQIKKQTALVELVKHKPKATKEQLKAVMDDFAAFVEKXXKADDKETXFAEEGKKLVAASQAALGL

SEQ ID NO: 1202 - protein, 1296 aa, Artificial Sequence
  Synthesized sequence with two or more selenocysteine residues substituted for two or more cysteine residues
  VARIANT (1)...(1296): Xaa = selenocysteine or cysteine
MPFVNKQFNYKDPVNGVDIAYIKIPNVGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLXVRGIITSKTKSLDKGYNKALNDLXIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKXKMNLQDNNGNDIGFIGFHQFNNIAKLVASNWYNRQIERSSRTLGXSWEFIPVDDGWGERPL

SEQ ID NO: 1203 - protein, 536 aa, Artificial Sequence
  Synthesized sequence with two or more selenocysteine residues substituted for two or more cysteine residues
  VARIANT (1)...(536): Xaa = selenocysteine or cysteine
MEFSSPSREECPKPLSRVSIMAGSLTGLLLLQAVSWASGARPXIPKSFGYSSVVXVXNATYXDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 1204 - protein, 282 aa, Artificial Sequence
  Synthesized sequence with two or more selenocysteine residues substituted for two or more cysteine residues
  VARIANT (1)...(282): Xaa = selenocysteine or cysteine
MRGMKLLGALLALAALLQGAVSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGXEPXGNDTFNREPAIVRFFSRFTEVREFAIVPLHAAPGDAVAEIDALYDVYLDVQEKWGLEDVMLMGDFNAGXSYVRPSQWSSIRLWTSPTFQWLIPDSADTTATPTHXAYDRIVVAGMLLRGAVVPDSALPFNFQAAYGLSDQLAQAISDHYPVEVMLK

SEQ ID NO: 1205 - protein, 562 aa, Artificial Sequence
  Synthesized sequence with two or more selenocysteine residues substituted for two or more cysteine residues
  VARIANT (1)...(562): Xaa = selenocysteine or cysteine
MDAMKRGLCCVLLLCGAVFVSPSQEIHARFRRGARSYQVIXRDEKTQMIYQQHQSWLRPVLRSNRVEYXWXNSGRAQXHSVPVKSXSEPRXFNGGTXQQALYFSDFVXQXPEGFAGKCXEIDTRATXYEDQGISYRGTWSTAESGAEXTNWNSSALAQKPYSGRRPDAIRLGLGNHNYXRNPDRDSKPWXYVFKAGKYSSEFXSTPAXSEGNSDXYFGNGSAYRGTHSLTESGASXLPWNSMILIGKVYTAQNPSAQALGLGKHNYXRNPDGDAKPWXHVLKNRRLTWEYXDVPSXSTXGLRQYSQPQFRIKGGLFADIASHPWQAAIFAKHRRSPGERFLXGGILISSXWILSAAHXFQERFPPHHLTVILGRTYRVVPGEEEQKFEVEKYIVHKEFDDDTYDNDIALLQLKSDSSRXAQESSVVRTVXLPPADLQLPDWTEXELSGYGKHEALSPFYSERLKEAHVRLYPSSRXTSQHLLNRTVTDNMLXAGDTRSGGPQANLHDAXQGDSGGPLVXLNDGRMTLVGIISWGLGXGQKDVPGVYTKVTNYLDWIRDNMRP

SEQ ID NO: 1206 - protein, 527 aa, Artificial Sequence
  Synthesized sequence with two or more selenocysteine residues substituted for two or more cysteine residues
  VARIANT (1)...(527): Xaa = selenocysteine or cysteine
SYQVIXRDEKTQMIYQQHQSWLRPVLRSNRVEYXWXNSGRAQXHSVPVKSXSEPRXFNGGTXQQALYFSDFVXQXPEGFAGKCXEIDTRATXYEDQGISYRGNWSTAESGAEXTQWNSSALAQKPYSGRRPDAIRLGLGNHNYXRNPDRDSKPWXYVFKAGKYSSEFXSTPAXSEGNSDXYFGNGSAYRGTHSLTESGASXLPWNSMILIGKVYTAQNPSAQALGLGKHNYXRNPDGDAKPWXHVLKNRRLTWEYXDVPSXSTXGLRQYSQPQFRIKGGLFADIASHPWQAAAAAKHRRSPGERFLXGGILISSXWILSAAHXFQERFPPHHLTVILGRTYRVVPGEEEQKFEVEKYIVHKEFDDDTYDNDIALLQLKSDSSRXAQESSVVRTVXLPPADLQLPDWTEXELSGYGKHEALSPFYSERLKEAHVRLYPSSRXTSQHLLNRTVTDNMLXAGDTRSGGPQANLHDAXQGDSGGPLVXLNDGRMTLVGIISWGLGXGQKDVPGVYTKVTNYLDWIRDNMRP

SEQ ID NO: 1207 - protein, 505 aa, Artificial Sequence
  Synthesized sequence with two or more selenocysteine residues substituted for two or more cysteine residues
  VARIANT (1)...(505): Xaa = selenocysteine or cysteine
MSLWLPSEATVYLPPVPVSKVVSTDEYVARTNIYYHAGTSRLLAVGHPYFPIKKPNNNKILVPKVSGLQYRVFRIHLPDPNKFGFPDTSFYNPDTQRLVWACVGVEVGRGQPLGVGISGHPLLNKLDDTENASAYAANAGVDNRECISMDYKQTQLCLIGCKPPIGEHWGKGSPXTNVAVNPGDCPPLELINTVIQDGDMVDTGFGAMDFTTLQANKSEVPLDICTSICKYPDYIKMVSEPYGDSLFFYLRREQMFVRHLFNRAGAVGENVPDDLYIKGSGSTANLASSNYFPTPSGSMVTSDAQIFNKPYWLQRAQGHNNGICWGNQLFVTVVDTTRSTNMSLCAAISTSETTYKNTNFKEYLRHGEEYDLQFIFQLCKITLTADVMTYIHSMNSTILEDWNFGLQPPPGGTLEDTYRFVTSQAIAXQKHTPPAPKEDPLKKYTFWEVNLKEKFSADLDQFPLGRKFLLQAGLKAKPKFTLGKRKATPTTSSTSTTAKRKKRKL

SEQ ID NO: 1208 - protein, 568 aa, Artificial Sequence
  Synthesized sequence with two or more selenocysteine residues substituted for two or more cysteine residues
  VARIANT (1)...(568): Xaa = selenocysteine or cysteine
MCLYTRVLILHYHLLPLYGPLYHPQPLPLHSILVYMVHIIICGHYIILFLRNVNVFPIFLQMALWRPSDNTVYLPPPSVARVVNTDDYVTRTSIFYHAGSSRLLTVGNPYFRVPAGGGNKQDIPKVSAYQYRVFRVQLPDPNKFGLPDTSIYNPETQRLVWACAGVEIGRGQPLGVGLSGHPFYNKLDDTESSHAATSNVSEDVRDNVSVDYKQTQLCILGCAPAIGEHWAKGTAXKSRPLSQGDCPPLELKNTVLEDGDMVDTGYGAMDFSTLQDTKCEVPLDICQSICKYPDYLQMSADPYGDSMFFCLRREQLFARHFWNRAGTMGDTVPQSLYIKGTGMRASPGSCVYSPSPSGSIVTSDSQLFNKPYWLHKAQGHNNGVCWHNQLFVTVVDTTRSTNLTICASTQSPVPGQYDATKFKQYSRHVEEYDLQFIFQLCTITLTADVMSYIHSMNSSILEDWNFGVPPPPTTSLVDTYRFVQSVAITXQKDAAPAENKDPYDKLKFWNVDLKEKFSLDLDQYPLGRKFLVQAGLRRKPTIGPRKRSAPSATTSSKPAKRVRVRARK

SEQ ID NO: 1209 - protein, 500 aa, Artificial Sequence
  Synthesized sequence with two or more selenocysteine residues substituted for two or more cysteine residues
  VARIANT (1)...(500): Xaa = selenocysteine or cysteine
MWRPSDSTVYVPPPNPVSKVVATDAYVTRTNIFYHASSSRLLAVGHPYFSIKRANKTVVPKVSGYQYRVFKVVLPDPNKFALPDSSLFDPTTQRLVWACTGLEVGRGQPLGVGVSGHPFLNKYDDVENSGSGGNPGQDNRVNVGMDYKQTQLCMVGCAPPLGEHWGKGKQXTNTPVQAGDCPPLELITSVIQDGDMVDTGFGAMNFADLQTNKSDVPIDICGTTCKYPDYLQMAADPYGDRLFFFLRKEQMFARHFFNRAGEVGEPVPDTLIIKGSGNRTSVGSSIYVNTPSGSLVSSEAQLFNKPYWLQKAQGHNNGICWGNQLFVTVVDTTRSTNMTLCASVTTSSTYTNSDYKEYMRHVEEYDLQFIFQLCSITLSAEVMAYIHTMNPSVLEDWNFGLSPPPNGTLEDTYRYVQSQAITXQKPTPEKEKPDPYKNLSFWEVNLKEKFSSELDQYPLGRKFLLQSGYRGRSSIRTGVKRPAVSKASAAPKRKRAKTKR

SEQ ID NO: 1210 - protein, 501 aa, Artificial Sequence
  Synthesized sequence with two or more selenocysteine residues substituted for two or more cysteine residues
  VARIANT (1)...(501): Xaa = selenocysteine or cysteine
MWRPSDSTVYVPPPNPVSKVVATDAYVKRTNIFYHASSSRLLAVGHPYYSIKKVNKTVVPKVSGYQYRVFKVVLPDPNKFALPDSSLFDPTTQRLVWACTGLEVGRGQPLGVGVSGHPLLNKYDDVENSGGYGGNPGQDNRVNVGMDYKQTQLCMVGCAPPLGEHWGKGTQXSNTSVQNGDCPPLELITSVIQDGDMVDTGFGAMNFADLQTNKSDVPLDICGTVCKYPDYLQMAADPYGDRLFFYLRKEQMFARHFFNRAGTVGEPVPDDLLVKGGNNRSSVASSIYVHTPSGSLVSSEAQLFNKPYWLQKAQGHNNGICWGNHLFVTVVDTTRSTNMTLCASVSKSATYTNSDYKEYMRHVEEFDLQFIFQLCSITLSAEVMAYIHTMNPSVLEDWNFGLSPPPNGTLEDTYRYVQSQAITXQKPTPEKEKQDPYKDMSFWEVNLKEKFSSELDQFPLGRKFLLQSGYRGRTSARTGIKRPAVSKPSTAPKRKRTKTKK

SEQ ID NO: 1211 - protein, 193 aa, Artificial Sequence
  Synthesized sequence with two or more selenocysteine residues substituted for two or more cysteine residues
  VARIANT (1)...(193): Xaa = selenocysteine or cysteine
GADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQAXAGNRVRR

SEQ ID NO: 1212 - protein, 342 aa, Artificial Sequence
  Synthesized sequence with two or more selenocysteine residues substituted for two or more cysteine residues
  VARIANT (1)...(342): Xaa = selenocysteine or cysteine
SVGSSLSXINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRXRAIDGDVTFXRPKSPVYVGNGVHANLHVAFHRSSSEKIHSNEISSDSIGVLGYQKTVDHTKVNSKLSLFFEIKS

SEQ ID NO: 1213 - protein, 193 aa, Artificial Sequence; identical to SEQ ID NO: 1211
  Synthesized sequence with two or more selenocysteine residues substituted for two or more cysteine residues
  VARIANT (1)...(193): Xaa = selenocysteine or cysteine

SEQ ID NO: 1214 - protein, 342 aa, Artificial Sequence; identical to SEQ ID NO: 1212
  Synthesized sequence with two or more selenocysteine residues substituted for two or more cysteine residues
  VARIANT (1)...(342): Xaa = selenocysteine or cysteine

SEQ ID NO: 1215 - protein, 456 aa, Artificial Sequence
  Synthesized sequence with two or more selenocysteine residues substituted for two or more cysteine residues
  VARIANT (1)...(456): Xaa = selenocysteine or cysteine
PITINNFRYSDPVNNDTIIMMEPPYCKGLDIYYKAFKITDRIWIVPERYEFGTKPEDFNPPSSLIEGASEYYDPNYLRTDSDKDRFLQTMVKLFNRIKNNVAGEALLDKIINAIPYLGNSYSLLDKFDTNSNSVSFNLLEQDPSGATTKSAMLTNLIIFGPGPVLNKNEVRGIVLRVDNKNYFPCRDGFGSIMQMAFCPEYVPTFDNVIENITSLTIGKSKYFQDPALLLMHELIHVLHGLYGMQVSSHEIIPSKQEIYMQHTYPISAEELFTFGGQDANLISIDIKNDLYEKTLNDYKAIANKLSQVTSCNDPNIDIDSYKQIYQQKYQFDKDSNGQYIVNEDKFQILYNSIMYGFTEIELGKKFNIKTRLSYFSMNHDPVKIPNLLDDTIYNDTEGFNIESKDLKSEYKGQNMRVNTNAFRNVDGSGLVSKLIGLXKKIIPPTNIRENLYNRTA

SEQ ID NO: 1216 - protein, 858 aa, Artificial Sequence
  Synthesized sequence with two or more selenocysteine residues substituted for two or more cysteine residues
  VARIANT (1)...(858): Xaa = selenocysteine or cysteine
SLTDLGGELXIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRXNNNNQYVSIDKFRIFXKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 1217 - protein, 357 aa, Artificial Sequence [sequence omitted]

SEQ ID NO: 1218 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKYTEVRVTVLRQADSQVTEVXAATYMMGNELTFLDDSIXTGTSSGNQVNLTIQGLRAMDTGLYIXKVELMYPPPYYEGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1219 - protein, 269 aa, Artificial Sequence
  Synthesized sequence with two or more selenocysteine residues substituted for two or more cysteine residues
  VARIANT (1)...(269): Xaa = selenocysteine or cysteine
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGKGGGGGIEGPTLRQWLAARAGGGGGGGGIEGPTLRQWLAARA

SEQ ID NO: 1220 - protein, 207 aa, Artificial Sequence
  Synthesized sequence with two or more selenocysteine residues substituted for two or more cysteine residues
  VARIANT (1)...(207): Xaa = selenocysteine or cysteine
MAGPATQSPMKLMALQLLLWHSALWTVQEATPLGPASSLPQSFLLKCLEQVRKIQGDGAALQEKLVSECATYKLCHPEELVLLGHSLGIPWAPLSSXPSQALQLAGXLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1221 - protein, 207 aa, Artificial Sequence
  Synthesized sequence with two or more selenocysteine residues substituted for two or more cysteine residues
  VARIANT (1)...(207): Xaa = selenocysteine or cysteine
MAGPATQSPMKLMALQLLLWHSALWTVQEATPLGPASSLPQSFLLKCLEQVRKIQGDGAALQEKLVSECATYKLXHPEELVLLGHSLGIPWAPLSSCPSQALQLAGXLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1222 - protein, 207 aa, Artificial Sequence
  Synthesized sequence with two or more selenocysteine residues substituted for two or more cysteine residues
  VARIANT (1)...(207): Xaa = selenocysteine or cysteine
MAGPATQSPMKLMALQLLLWHSALWTVQEATPLGPASSLPQSFLLKCLEQVRKIQGDGAALQEKLVSECATYKLXHPEELVLLGHSLGIPWAPLSSXPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1223 - protein, 207 aa, Artificial Sequence
  Synthesized sequence with two or more selenocysteine residues substituted for two or more cysteine residues
  VARIANT (1)...(207): Xaa = selenocysteine or cysteine
MAGPATQSPMKLMALQLLLWHSALWTVQEATPLGPASSLPQSFLLKCLEQVRKIQGDGAALQEKLVSEXATYKLCHPEELVLLGHSLGIPWAPLSSCPSQALQLAGXLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1224 - protein, 207 aa, Artificial Sequence
  Synthesized sequence with two or more selenocysteine residues substituted for two or more cysteine residues
  VARIANT (1)...(207): Xaa = selenocysteine or cysteine
MAGPATQSPMKLMALQLLLWHSALWTVQEATPLGPASSLPQSFLLKCLEQVRKIQGDGAALQEKLVSEXATYKLCHPEELVLLGHSLGIPWAPLSSXPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1225 - protein, 207 aa, Artificial Sequence
  Synthesized sequence with two or more selenocysteine residues substituted for two or more cysteine residues
  VARIANT (1)...(207): Xaa = selenocysteine or cysteine
MAGPATQSPMKLMALQLLLWHSALWTVQEATPLGPASSLPQSFLLKCLEQVRKIQGDGAALQEKLVSEXATYKLXHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1226 - protein, 175 aa, Artificial Sequence
  Synthesized sequence with two or more selenocysteine residues substituted for two or more cysteine residues
  VARIANT (1)...(175): Xaa = selenocysteine or cysteine
MTPLGPASSLPQSFLLKCLEQVRKIQGDGAALQEKLCATYKLCHPEELVLLGHSLGIPWAPLSSXPSQALQLAGXLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1227 - protein, 175 aa, Artificial Sequence
  Synthesized sequence with two or more selenocysteine residues substituted for two or more cysteine residues
  VARIANT (1)...(175): Xaa = selenocysteine or cysteine
MTPLGPASSLPQSFLLKCLEQVRKIQGDGAALQEKLCATYKLXHPEELVLLGHSLGIPWAPLSSCPSQALQLAGXLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1228 - protein, 175 aa, Artificial Sequence
  Synthesized sequence with two or more selenocysteine residues substituted for two or more cysteine residues
  VARIANT (1)...(175): Xaa = selenocysteine or cysteine
MTPLGPASSLPQSFLLKCLEQVRKIQGDGAALQEKLCATYKLXHPEELVLLGHSLGIPWAPLSSXPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1229 - protein, 175 aa, Artificial Sequence
  Synthesized sequence with two or more selenocysteine residues substituted for two or more cysteine residues
  VARIANT (1)...(175): Xaa = selenocysteine or cysteine
MTPLGPASSLPQSFLLKCLEQVRKIQGDGAALQEKLXATYKLCHPEELVLLGHSLGIPWAPLSSCPSQALQLAGXLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1230 - protein, 175 aa, Artificial Sequence
  Synthesized sequence with two or more selenocysteine residues substituted for two or more cysteine residues
  VARIANT (1)...(175): Xaa = selenocysteine or cysteine
MTPLGPASSLPQSFLLKCLEQVRKIQGDGAALQEKLXATYKLCHPEELVLLGHSLGIPWAPLSSXPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1231 - protein, 175 aa, Artificial Sequence
  Synthesized sequence with two or more selenocysteine residues substituted for two or more cysteine residues
  VARIANT (1)...(175): Xaa = selenocysteine or cysteine
MTPLGPASSLPQSFLLKCLEQVRKIQGDGAALQEKLXATYKLXHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1232 - protein, 192 aa, Artificial Sequence
  Synthesized sequence with two or more selenocysteine residues substituted for two or more cysteine residues
  VARIANT (1)...(192): Xaa = selenocysteine or cysteine
MFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQXRSVEGSXGF

SEQ ID NO: 1233 - protein, 192 aa, Artificial Sequence
  Synthesized sequence with two or more selenocysteine residues substituted for two or more cysteine residues
  VARIANT (1)...(192): Xaa = selenocysteine or cysteine
MFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYXFRKDMDKVETFLRIVQCRSVEGSXGF

SEQ ID NO: 1234 - protein, 192 aa, Artificial Sequence
  Synthesized sequence with two or more selenocysteine residues substituted for two or more cysteine residues
  VARIANT (1)...(192): Xaa = selenocysteine or cysteine
MFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYXFRKDMDKVETFLRIVQXRSVEGSCGF

SEQ ID NO: 1235 - protein, 192 aa, Artificial Sequence
  Synthesized sequence with two or more selenocysteine residues substituted for two or more cysteine residues
  VARIANT (1)...(192): Xaa = selenocysteine or cysteine
MFPTIPLSRLFDNAMLRAHRLHQLAFDTYQEFEEAYIPKEQKYSFLQNPQTSLXFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSXGF

SEQ ID NO: 1236 - protein, 192 aa, Artificial Sequence
  Synthesized sequence with two or more selenocysteine residues substituted for two or more cysteine residues
  VARIANT (1)...(192): Xaa = selenocysteine or cysteine
MFPTIPLSRLFDNAMLRAHRLHQLAFDTYQEFEEAYIPKEQKYSFLQNPQTSLXFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQXRSVEGSCGF

SEQ ID NO: 1237 - protein, 192 aa, Artificial Sequence
  Synthesized sequence with two or more selenocysteine residues substituted for two or more cysteine residues
  VARIANT (1)...(192): Xaa = selenocysteine or cysteine
MFPTIPLSRLFDNAMLRAHRLHQLAFDTYQEFEEAYIPKEQKYSFLQNPQTSLXFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYXFRKDMDKVETFLRIVQCRSVEGSCGF

SEQ ID NO: 1238 - protein, 217 aa, Artificial Sequence
  Synthesized sequence with two or more selenocysteine residues substituted for two or more cysteine residues
  VARIANT (1)...(217): Xaa = selenocysteine or cysteine
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQXRSVEGSXGF

SEQ ID NO: 1239 - protein, 217 aa, Artificial Sequence
  Synthesized sequence with two or more selenocysteine residues substituted for two or more cysteine residues
  VARIANT (1)...(217): Xaa = selenocysteine or cysteine
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYXFRKDMDKVETFLRIVQCRSVEGSXGF

SEQ ID NO: 1240 - protein, 217 aa, Artificial Sequence
  Synthesized sequence with two or more selenocysteine residues substituted for two or more cysteine residues
  VARIANT (1)...(217): Xaa = selenocysteine or cysteine
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYXFRKDMDKVETFLRIVQXRSVEGSCGF

SEQ ID NO: 1241 - protein, 217 aa, Artificial Sequence
  Synthesized sequence with two or more selenocysteine residues substituted for two or more cysteine residues
  VARIANT (1)...(217): Xaa = selenocysteine or cysteine
MATGSRTSLLLAFGLLCLPWLQEGSAFPTIPLSRLFDNAMLRAHRLHQLAFDTYQEFEEAYIPKEQKYSFLQNPQTSLXFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSXGF

SEQ ID NO: 1242 - protein, 217 aa, Artificial Sequence
  Synthesized sequence with two or more selenocysteine residues substituted for two or more cysteine residues
  VARIANT (1)...(217): Xaa = selenocysteine or cysteine
MATGSRTSLLLAFGLLCLPWLQEGSAFPTIPLSRLFDNAMLRAHRLHQLAFDTYQEFEEAYIPKEQKYSFLQNPQTSLXFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQXRSVEGSCGF

SEQ ID NO: 1243 - protein, 217 aa, Artificial Sequence
  Synthesized sequence with two or more selenocysteine residues substituted for two or more cysteine residues
  VARIANT (1)...(217): Xaa = selenocysteine or cysteine
MATGSRTSLLLAFGLLCLPWLQEGSAFPTIPLSRLFDNAMLRAHRLHQLAFDTYQEFEEAYIPKEQKYSFLQNPQTSLXFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYXFRKDMDKVETFLRIVQCRSVEGSCGF

SEQ ID NO: 1244 - protein, 167 aa, Artificial Sequence
  Synthesized sequence with two or more selenocysteine residues substituted for two or more cysteine residues
  VARIANT (1)...(167): Xaa = selenocysteine or cysteine
MAPPRLICDSRVLERYLLEAKEAENITTGCAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGDR

SEQ ID NO: 1245 - protein, 167 aa, Artificial Sequence
  Synthesized sequence with two or more selenocysteine residues substituted for two or more cysteine residues
  VARIANT (1)...(167): Xaa = selenocysteine or cysteine
MAPPRLICDSRVLERYLLEAKEAENITTGXAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGDR

SEQ ID NO: 1246 - protein, 167 aa, Artificial Sequence
  Synthesized sequence with two or more selenocysteine residues substituted for two or more cysteine residues
  VARIANT (1)...(167): Xaa = selenocysteine or cysteine
MAPPRLICDSRVLERYLLEAKEAENITTGXAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 1247 - protein, 167 aa, Artificial Sequence
  Synthesized sequence with two or more selenocysteine residues substituted for two or more cysteine residues
  VARIANT (1)...(167): Xaa = selenocysteine or cysteine
MAPPRLIXDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGDR

SEQ ID NO: 1248 - protein, 167 aa, Artificial Sequence
  Synthesized sequence with two or more selenocysteine residues substituted for two or more cysteine residues
  VARIANT (1)...(167): Xaa = selenocysteine or cysteine
MAPPRLIXDSRVLERYLLEAKEAENITTGCAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 1249 - protein, 167 aa, Artificial Sequence
  Synthesized sequence with two or more selenocysteine residues substituted for two or more cysteine residues
  VARIANT (1)...(167): Xaa = selenocysteine or cysteine
MAPPRLIXDSRVLERYLLEAKEAENITTGXAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 1250 - protein, 166 aa, Artificial Sequence
  Synthesized sequence with two or more selenocysteine residues substituted for two or more cysteine residues
  VARIANT (1)...(166): Xaa = selenocysteine or cysteine
APPRLICDSRVLERYLLEAKEAENITTGCAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGDR

SEQ ID NO: 1251 - protein, 166 aa, Artificial Sequence
  Synthesized sequence with two or more selenocysteine residues substituted for two or more cysteine residues
  VARIANT (1)...(166): Xaa = selenocysteine or cysteine
APPRLICDSRVLERYLLEAKEAENITTGXAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGDR

SEQ ID NO: 1252 - protein, 166 aa, Artificial Sequence
  Synthesized sequence with two or more selenocysteine residues substituted for two or more cysteine residues
  VARIANT (1)...(166): Xaa = selenocysteine or cysteine
APPRLICDSRVLERYLLEAKEAENITTGXAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 1253 - protein, 166 aa, Artificial Sequence
  Synthesized sequence with two or more selenocysteine residues substituted for two or more cysteine residues
  VARIANT (1)...(166): Xaa = selenocysteine or cysteine
APPRLIXDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGDR

SEQ ID NO: 1254 - protein, 166 aa, Artificial Sequence
  Synthesized sequence with two or more selenocysteine residues substituted for two or more cysteine residues
  VARIANT (1)...(166): Xaa = selenocysteine or cysteine
APPRLIXDSRVLERYLLEAKEAENITTGCAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 1255 - protein, 166 aa, Artificial Sequence
  Synthesized sequence with two or more selenocysteine residues substituted for two or more cysteine residues
  VARIANT (1)...(166): Xaa = selenocysteine or cysteine
APPRLIXDSRVLERYLLEAKEAENITTGXAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 1256 - protein, 166 aa, Artificial Sequence; identical to SEQ ID NO: 1250
  Synthesized sequence with two or more selenocysteine residues substituted for two or more cysteine residues
  VARIANT (1)...(166): Xaa = selenocysteine or cysteine

SEQ ID NO: 1257 - protein, 166 aa, Artificial Sequence; identical to SEQ ID NO: 1251
  Synthesized sequence with two or more selenocysteine residues substituted for two or more cysteine residues
  VARIANT (1)...(166): Xaa = selenocysteine or cysteine

SEQ ID NO: 1258 - protein, 166 aa, Artificial Sequence; identical to SEQ ID NO: 1252
  Synthesized sequence with two or more selenocysteine residues substituted for two or more cysteine residues
  VARIANT (1)...(166): Xaa = selenocysteine or cysteine

SEQ ID NO: 1259 - protein, 166 aa, Artificial Sequence; identical to SEQ ID NO: 1253
  Synthesized sequence with two or more selenocysteine residues substituted for two or more cysteine residues
  VARIANT (1)...(166): Xaa = selenocysteine or cysteine

SEQ ID NO: 1260 - protein, 166 aa, Artificial Sequence; identical to SEQ ID NO: 1254
  Synthesized sequence with two or more selenocysteine residues substituted for two or more cysteine residues
  VARIANT (1)...(166): Xaa = selenocysteine or cysteine

SEQ ID NO: 1261 - protein, 166 aa, Artificial Sequence; identical to SEQ ID NO: 1255
  Synthesized sequence with two or more selenocysteine residues substituted for two or more cysteine residues
  VARIANT (1)...(166): Xaa = selenocysteine or cysteine

SEQ ID NO: 1262 - protein, 165 aa, Artificial Sequence
  Synthesized sequence with two or more selenocysteine residues substituted for two or more cysteine residues
  VARIANT (1)...(165): Xaa = selenocysteine or cysteine
APPRLICDSRVLERYLLEAKEAENITTGCAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGD

SEQ ID NO: 1263 - protein, 165 aa, Artificial Sequence
  Synthesized sequence with two or more selenocysteine residues substituted for two or more cysteine residues
  VARIANT (1)...(165): Xaa = selenocysteine or cysteine
APPRLICDSRVLERYLLEAKEAENITTGXAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGD

SEQ ID NO: 1264 - protein, 165 aa, Artificial Sequence
  Synthesized sequence with two or more selenocysteine residues substituted for two or more cysteine residues
  VARIANT (1)...(165): Xaa = selenocysteine or cysteine
APPRLICDSRVLERYLLEAKEAENITTGXAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGD

SEQ ID NO: 1265 - protein, 165 aa, Artificial Sequence
  Synthesized sequence with two or more selenocysteine residues substituted for two or more cysteine residues
  VARIANT (1)...(165): Xaa = selenocysteine or cysteine
APPRLIXDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEAXRTGD

SEQ ID NO: 1266 - protein, 165 aa, Artificial Sequence
  Synthesized sequence with two or more selenocysteine residues substituted for two or more cysteine residues
  VARIANT (1)...(165): Xaa = selenocysteine or cysteine
APPRLIXDSRVLERYLLEAKEAENITTGCAEHXSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGD

SEQ ID NO: 1267 - protein, 165 aa, Artificial Sequence
  Synthesized sequence with two or more selenocysteine residues substituted for two or more cysteine residues
  VARIANT (1)...(165): Xaa = selenocysteine or cysteine
APPRLIXDSRVLERYLLEAKEAENITTGXAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGD

SEQ ID NO: 1268 - protein, 467 aa, Artificial Sequence
  Synthesized sequence with two or more selenocysteine residues substituted for two or more cysteine residues
  VARIANT (1)...(467): Xaa = selenocysteine or cysteine
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDEPKSXDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1269 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKATEVRVTVLRQADSQVTEVCAATYMMGNELTFLDDSICTGTSSGNQVNLTIQGLRAMDTGLYIXKVELMYPPPYYLGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1270 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKATEVRVTVLRQADSQVTEVXAATYMMGNELTFLDDSIXTGTSSGNQVNLTIQGLRAMDTGLYICKVELMYPPPYYLGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1271 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1272 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1273 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKATEVRVTVLRQADSQVTEVXAATYMMGNELTFLDDSIXTGTSSGNQVNLTIQGLRAMDTGLYIXKVELMYPPPYYLGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1274 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKATEVRVTVLRQADSQVTEVCAATYMMGNELTFLDDSICTGTSSGNQVNLTIQGLRAMDTGLYIXKVELMYPPPYYLGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1275 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKATEVRVTVLRQADSQVTEVCAATYMMGNELTFLDDSICTGTSSGNQVNLTIQGLRAMDTGLYIXKVELMYPPPYYLGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1276 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKATEVRVTVLRQADSQVTEVXAATYMMGNELTFLDDSIXTGTSSGNQVNLTIQGLRAMDTGLYICKVELMYPPPYYLGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1277 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKATEVRVTVLRQADSQVTEVXAATYMMGNELTFLDDSIXTGTSSGNQVNLTIQGLRAMDTGLYICKVELMYPPPYYLGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1278 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1279 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKATEVRVTVLRQADSQVTEVXAATYMMGNELTFLDDSIXTGTSSGNQVNLTIQGLRAMDTGLYIXKVELMYPPPYYLGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1280 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKATEVRVTVLRQADSQVTEVXAATYMMGNELTFLDDSIXTGTSSGNQVNLTIQGLRAMDTGLYIXKVELMYPPPYYLGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1281 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKATEVRVTVLRQADSQVTEVXAATYMMGNELTFLDDSIXTGTSSGNQVNLTIQGLRAMDTGLYICKVELMYPPPYYLGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1282 - protein, 165 aa, Artificial Sequence
  Synthesized sequence with two or more selenocysteine residues substituted for two or more cysteine residues
  VARIANT (1)...(165): Xaa = selenocysteine or cysteine
XDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEAXVIQGVGVTETPLMKEDSILAVRKYFQRITLYLKEKKYSPCAWEVVRAEIMRSFSLSTNLQESLRSKE

SEQ ID NO: 1283 - protein, 165 aa, Artificial Sequence
  Synthesized sequence with two or more selenocysteine residues substituted for two or more cysteine residues
  VARIANT (1)...(165): Xaa = selenocysteine or cysteine
CDLPQTHSLGSRRTLMLLAQMRRISLFSXLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPXAWEVVRAEIMRSFSLSTNLQESLRSKE

SEQ ID NO: 1284 - protein, 165 aa, Artificial Sequence
  Synthesized sequence with two or more selenocysteine residues substituted for two or more cysteine residues
  VARIANT (1)...(165): Xaa = selenocysteine or cysteine
XDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEAXVIQGVGVTETPLMKEDSILAVRKYFQRITLYLKEKKYSPCAWEVVRAEIMRSFSLSTNLQESLRSKE

SEQ ID NO: 1285 - protein, 165 aa, Artificial Sequence
  Synthesized sequence with two or more selenocysteine residues substituted for two or more cysteine residues
  VARIANT (1)...(165): Xaa = selenocysteine or cysteine
CDLPQTHSLGSRRTLMLLAQMRKISLFSXLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPXAWEVVRAEIMRSFSLSTNLQESLRSKE

SEQ ID NO: 1286 - protein, 165 aa, Artificial Sequence
  Synthesized sequence with two or more selenocysteine residues substituted for two or more cysteine residues
  VARIANT (1)...(165): Xaa = selenocysteine or cysteine
XDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEAXVIQGVGVTETPLMNEDSILAVRKYFQRITLYLKEKKYSPCAWEVVRAEIMRSFSLSTNLQESLRSKE

SEQ ID NO: 1287 - protein, 165 aa, Artificial Sequence
  Synthesized sequence with two or more selenocysteine residues substituted for two or more cysteine residues
  VARIANT (1)...(165): Xaa = selenocysteine or cysteine
CDLPQTHSLGSRRTLMLLAQMRRISLFSXLKDRHDFGFPQEEFGNQFQKAETIPVLHEMIQQIFNLFSTKDSSAAWDETLLDKFYTELYQQLNDLEACVIQGVGVTETPLMNEDSILAVRKYFQRITLYLKEKKYSPXAWEVVRAEIMRSFSLSTNLQESLRSKE

SEQ ID NO: 1288 - protein, 1296 aa, Artificial Sequence
  Synthesized sequence with two or more selenocysteine residues substituted for two or more cysteine residues
  VARIANT (1)...(1296): Xaa = selenocysteine or cysteine
MPFVNKQFNYKDPVNGVDIAYIKIPNVGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLXVRGIITSKTKSLDKGYNKALNDLXIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 1289 - protein, 1296 aa, Artificial Sequence
  Synthesized sequence with two or more selenocysteine residues substituted for two or more cysteine residues
  VARIANT (1)...(1296): Xaa = selenocysteine or cysteine
MPFVNKQFNYKDPVNGVDIAYIKIPNVGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKXKMNLQDNNGNDIGFIGFHQFNNIAKLVASNWYNRQIERSSRTLGXSWEFIPVDDGWGERPL

SEQ ID NO: 1290 - protein, 19 aa, Artificial Sequence
  Synthesized sequence with two or more selenocysteine residues substituted for two or more cysteine residues
  VARIANT (1)...(19): Xaa = selenocysteine or cysteine
APSFDXGKPQVEPKKCPGR

SEQ ID NO: 1291 - protein, 19 aa, Artificial Sequence
  Synthesized sequence with two or more selenocysteine residues substituted for two or more cysteine residues
  VARIANT (1)...(19): Xaa = selenocysteine or cysteine
APSFDCGKPQVEPKKXPGR

SEQ ID NO: 1292 - protein, 19 aa, Artificial Sequence
  Synthesized sequence with two or more selenocysteine residues substituted for two or more cysteine residues
  VARIANT (1)...(19): Xaa = selenocysteine or cysteine
APSFDXGKPQVEPKKXPGR

SEQ ID NO: 1293 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKYTEVRVTVLRQADSQVTEVCAATYMMGNELTFLDDSICTGTSSGNQVNLTIQGLRAMDTGLYIXKVELMYPPPYYEGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1294 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKYTEVRVTVLRQADSQVTEVXAATYMMGNELTFLDDSIXTGTSSGNQVNLTIQGLRAMDTGLYICKVELMYPPPYYEGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1295 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1296 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1297 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKYTEVRVTVLRQADSQVTEVXAATYMMGNELTFLDDSIXTGTSSGNQVNLTIQGLRAMDTGLYIXKVELMYPPPYYEGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1298 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKYTEVRVTVLRQADSQVTEVCAATYMMGNELTFLDDSICTGTSSGNQVNLTIQGLRAMDTGLYIXKVELMYPPPYYEGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1299 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKYTEVRVTVLRQADSQVTEVCAATYMMGNELTFLDDSICTGTSSGNQVNLTIQGLRAMDTGLYIXKVELMYPPPYYEGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1300 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKYTEVRVTVLRQADSQVTEVXAATYMMGNELTFLDDSIXTGTSSGNQVNLTIQGLRAMDTGLYICKVELMYPPPYYEGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1301 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKYTEVRVTVLRQADSQVTEVXAATYMMGNELTFLDDSIXTGTSSGNQVNLTIQGLRAMDTGLYICKVELMYPPPYYEGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1302 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1303 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKYTEVRVTVLRQADSQVTEVXAATYMMGNELTFLDDSIXTGTSSGNQVNLTIQGLRAMDTGLYIXKVELMYPPPYYEGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1304 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKYTEVRVTVLRQADSQVTEVXAATYMMGNELTFLDDSIXTGTSSGNQVNLTIQGLRAMDTGLYIXKVELMYPPPYYEGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1305 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVXEYASPGKYTEVRVTVLRQADSQVTEVCAATYMMGNELTFLDDSICTGTSSGNQVNLTIQGLRAMDTGLYIXKVELMYPPPYYEGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1306 - protein, 357 aa, Artificial Sequence
  Synthesized sequence with two or more selenocysteine residues substituted for two or more cysteine residues
  VARIANT (1)...(357): Xaa = selenocysteine or cysteine
MHVAQPAVVLASSRGIASFVCEYASPGKYTEVRVTVLRQADSQVTEVXAATYMMGNELTFLDDSIXTGTSSGNQVNLTIQGLRAMDTGLYICKVELMYPPPYYEGIGNGTQIYVIDPEPXPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPGK

SEQ ID NO: 1307 - protein, 357 aa, Artificial Sequence; identical to SEQ ID NO: 1218
  Synthesized sequence with two or more selenocysteine residues substituted for two or more cysteine residues
  VARIANT (1)...(357): Xaa = selenocysteine or cysteine

SEQ ID NO: 1308 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1309 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1310 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1311 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTXPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1312 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1313 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1314 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1315 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTXPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1316 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1317 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1318 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTXPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1319 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTCPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1320 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTXPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1321 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1322 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTXPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1323 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1324 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTXPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1325 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTCPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1326 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTXPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1327 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1328 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTXPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1329 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTXPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1330 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTCPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1331 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTXPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1332 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTXPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1333 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTCPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1334 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTXPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1335 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTXPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1336 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTXPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1337 - protein, 431 aa, Artificial Sequence
  Synthesized sequence with two or more selenocysteine residues substituted for two or more cysteine residues
  VARIANT (1)...(431): Xaa = selenocysteine or cysteine
SDTGRPFVEMYSEIPEIIHMTEGRELVIPXRVTSPNITVTLKKFPLDTLIPDGKRIIWDSRKGFIISNATYKEIGLLTXEATVNGHLYKTNYLTHRQTNTIIDVVLSPSHGIELSVGEKLVLNXTARTELNVGIDFNWEYPSSKHQHKKLVNRDLKTQSGSEMKKFLSTLTIDGVTRSDQGLYTXAASSGLMTKKNSTFVRVHEKDKTHTXPPXPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTXLVKGFYPSDIAVEWESNGQPENNYKTTPPVLDSDGSFFLYSKLTVDKSRWQQGNVFSXSVMHEALHNHYTQKSLSLSPG

SEQ ID NO: 1338 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1339 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1340 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1341 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVCNRYEFLNGRVQSTELCAGHLAGGTDSCQGDSGGPLVXFEKDKYILQGVTSWGLGCARPNKPGVYVRVSRFVTWIEGVMRNN

SEQ ID NO: 1342 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVXNRYEFLNGRVQSTELXAGHLAGGTDSCQGDSGGPLVCFEKDKYILQGVTSWGLGCARPNKPGVYVRVSRFVTWIEGVMRNN

SEQ ID NO: 1343 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSXQGDSGGPLVCFEKDKYILQGVTSWGLGXARPNKPGVYVRVSRFVTWIEGVMRNN

SEQ ID NO: 1344 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1345 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1346 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVCNRYEFLNGRVQSTELCAGHLAGGTDSCQGDSGGPLVXFEKDKYILQGVTSWGLGCARPNKPGVYVRVSRFVTWIEGVMRNN

SEQ ID NO: 1347 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVXNRYEFLNGRVQSTELXAGHLAGGTDSCQGDSGGPLVCFEKDKYILQGVTSWGLGCARPNKPGVYVRVSRFVTWIEGVMRNN

SEQ ID NO: 1348 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVCNRYEFLNGRVQSTELCAGHLAGGTDSXQGDSGGPLVCFEKDKYILQGVTSWGLGXARPNKPGVYVRVSRFVTWIEGVMRNN

SEQ ID NO: 1349 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1350 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVCNRYEFLNGRVQSTELCAGHLAGGTDSCQGDSGGPLVXFEKDKYILQGVTSWGLGCARPNKPGVYVRVSRFVTWIEGVMRNN

SEQ ID NO: 1351 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVXNRYEFLNGRVQSTELXAGHLAGGTDSCQGDSGGPLVCFEKDKYILQGVTSWGLGCARPNKPGVYVRVSRFVTWIEGVMRNN

SEQ ID NO: 1352 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSXQGDSGGPLVCFEKDKYILQGVTSWGLGXARPNKPGVYVRVSRFVTWIEGVMRNN

SEQ ID NO: 1353 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVCNRYEFLNGRVQSTELCAGHLAGGTDSCQGDSGGPLVXFEKDKYILQGVTSWGLGCARPNKPGVYVRVSRFVTWIEGVMRNN

SEQ ID NO: 1354 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVXNRYEFLNGRVQSTELXAGHLAGGTDSCQGDSGGPLVCFEKDKYILQGVTSWGLGCARPNKPGVYVRVSRFVTWIEGVMRNN

SEQ ID NO: 1355 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSXQGDSGGPLVCFEKDKYILQGVTSWGLGXARPNKPGVYVRVSRFVTWIEGVMRNN

SEQ ID NO: 1356 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVXNRYEFLNGRVQSTELXAGHLAGGTDSCQGDSGGPLVXFEKDKYILQGVTSWGLGCARPNKPGVYVRVSRFVTWIEGVMRNN

SEQ ID NO: 1357 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVCNRYEFLNGRVQSTELCAGHLAGGTDSXQGDSGGPLVXFEKDKYILQGVTSWGLGXARPNKPGVYVRVSRFVTWIEGVMRNN

SEQ ID NO: 1358 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVXNRYEFLNGRVQSTELXAGHLAGGTDSXQGDSGGPLVCFEKDKYILQGVTSWGLGXARPNKPGVYVRVSRFVTWIEGVMRNN

SEQ ID NO: 1359 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1360 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVCNRYEFLNGRVQSTELCAGHLAGGTDSCQGDSGGPLVXFEKDKYILQGVTSWGLGCARPNKPGVYVRVSRFVTWIEGVMRNN

SEQ ID NO: 1361 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVXNRYEFLNGRVQSTELXAGHLAGGTDSCQGDSGGPLVCFEKDKYILQGVTSWGLGCARPNKPGVYVRVSRFVTWIEGVMRNN

SEQ ID NO: 1362 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVCNRYEFLNGRVQSTELCAGHLAGGTDSXQGDSGGPLVCFEKDKYILQGVTSWGLGXARPNKPGVYVRVSRFVTWIEGVMRNN

SEQ ID NO: 1363 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVCNRYEFLNGRVQSTELCAGHLAGGTDSCQGDSGGPLVXFEKDKYILQGVTSWGLGCARPNKPGVYVRVSRFVTWIEGVMRNN

SEQ ID NO: 1364 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVXNRYEFLNGRVQSTELXAGHLAGGTDSCQGDSGGPLVCFEKDKYILQGVTSWGLGCARPNKPGVYVRVSRFVTWIEGVMRNN

SEQ ID NO: 1365 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVCNRYEFLNGRVQSTELCAGHLAGGTDSXQGDSGGPLVCFEKDKYILQGVTSWGLGXARPNKPGVYVRVSRFVTWIEGVMRNN

SEQ ID NO: 1366 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVXNRYEFLNGRVQSTELXAGHLAGGTDSCQGDSGGPLVXFEKDKYILQGVTSWGLGCARPNKPGVYVRVSRFVTWIEGVMRNN

SEQ ID NO: 1367 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVCNRYEFLNGRVQSTELCAGHLAGGTDSXQGDSGGPLVXFEKDKYILQGVTSWGLGXARPNKPGVYVRVSRFVTWIEGVMRNN

SEQ ID NO: 1368 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVXNRYEFLNGRVQSTELXAGHLAGGTDSXQGDSGGPLVCFEKDKYILQGVTSWGLGXARPNKPGVYVRVSRFVTWIEGVMRNN

SEQ ID NO: 1369 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVCNRYEFLNGRVQSTELCAGHLAGGTDSCQGDSGGPLVXFEKDKYILQGVTSWGLGCARPNKPGVYVRVSRFVTWIEGVMRNN

SEQ ID NO: 1370 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVXNRYEFLNGRVQSTELXAGHLAGGTDSCQGDSGGPLVCFEKDKYILQGVTSWGLGCARPNKPGVYVRVSRFVTWIEGVMRNN

SEQ ID NO: 1371 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSXQGDSGGPLVCFEKDKYILQGVTSWGLGXARPNKPGVYVRVSRFVTWIEGVMRNN

SEQ ID NO: 1372 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVXNRYEFLNGRVQSTELXAGHLAGGTDSCQGDSGGPLVXFEKDKYILQGVTSWGLGCARPNKPGVYVRVSRFVTWIEGVMRNN

SEQ ID NO: 1373 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVCNRYEFLNGRVQSTELCAGHLAGGTDSXQGDSGGPLVXFEKDKYILQGVTSWGLGXARPNKPGVYVRVSRFVTWIEGVMRNN

SEQ ID NO: 1374 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVXNRYEFLNGRVQSTELXAGHLAGGTDSXQGDSGGPLVCFEKDKYILQGVTSWGLGXARPNKPGVYVRVSRFVTWIEGVMRNN

SEQ ID NO: 1375 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVXNRYEFLNGRVQSTELXAGHLAGGTDSCQGDSGGPLVXFEKDKYILQGVTSWGLGCARPNKPGVYVRVSRFVTWIEGVMRNN

SEQ ID NO: 1376 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVCNRYEFLNGRVQSTELCAGHLAGGTDSXQGDSGGPLVXFEKDKYILQGVTSWGLGXARPNKPGVYVRVSRFVTWIEGVMRNN

SEQ ID NO: 1377 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVXNRYEFLNGRVQSTELXAGHLAGGTDSXQGDSGGPLVCFEKDKYILQGVTSWGLGXARPNKPGVYVRVSRFVTWIEGVMRNN

SEQ ID NO: 1378 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVXNRYEFLNGRVQSTELXAGHLAGGTDSXQGDSGGPLVXFEKDKYILQGVTSWGLGXARPNKPGVYVRVSRFVTWIEGVMRNN

SEQ ID NO: 1379 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVCNRYEFLNGRVQSTELCAGHLAGGTDSCQGDSGGPLVXFEKDKYILQGVTSWGLGCARPNKPGVYVRVSRFVTWIEGVMRNN

SEQ ID NO: 1380 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVXNRYEFLNGRVQSTELXAGHLAGGTDSCQGDSGGPLVCFEKDKYILQGVTSWGLGCARPNKPGVYVRVSRFVTWIEGVMRNN

SEQ ID NO: 1381 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVCNRYEFLNGRVQSTELCAGHLAGGTDSXQGDSGGPLVCFEKDKYILQGVTSWGLGXARPNKPGVYVRVSRFVTWIEGVMRNN

SEQ ID NO: 1382 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVXNRYEFLNGRVQSTELXAGHLAGGTDSCQGDSGGPLVXFEKDKYILQGVTSWGLGCARPNKPGVYVRVSRFVTWIEGVMRNN

SEQ ID NO: 1383 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVCNRYEFLNGRVQSTELCAGHLAGGTDSXQGDSGGPLVXFEKDKYILQGVTSWGLGXARPNKPGVYVRVSRFVTWIEGVMRNN

SEQ ID NO: 1384 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVXNRYEFLNGRVQSTELXAGHLAGGTDSXQGDSGGPLVCFEKDKYILQGVTSWGLGXARPNKPGVYVRVSRFVTWIEGVMRNN

SEQ ID NO: 1385 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVXNRYEFLNGRVQSTELXAGHLAGGTDSCQGDSGGPLVXFEKDKYILQGVTSWGLGCARPNKPGVYVRVSRFVTWIEGVMRNN

SEQ ID NO: 1386 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVCNRYEFLNGRVQSTELCAGHLAGGTDSXQGDSGGPLVXFEKDKYILQGVTSWGLGXARPNKPGVYVRVSRFVTWIEGVMRNN

SEQ ID NO: 1387 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVXNRYEFLNGRVQSTELXAGHLAGGTDSXQGDSGGPLVCFEKDKYILQGVTSWGLGXARPNKPGVYVRVSRFVTWIEGVMRNN

SEQ ID NO: 1388 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVXNRYEFLNGRVQSTELXAGHLAGGTDSXQGDSGGPLVXFEKDKYILQGVTSWGLGXARPNKPGVYVRVSRFVTWIEGVMRNN

SEQ ID NO: 1389 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVXNRYEFLNGRVQSTELXAGHLAGGTDSCQGDSGGPLVXFEKDKYILQGVTSWGLGCARPNKPGVYVRVSRFVTWIEGVMRNN

SEQ ID NO: 1390 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVCNRYEFLNGRVQSTELCAGHLAGGTDSXQGDSGGPLVXFEKDKYILQGVTSWGLGXARPNKPGVYVRVSRFVTWIEGVMRNN

SEQ ID NO: 1391 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVXNRYEFLNGRVQSTELXAGHLAGGTDSXQGDSGGPLVCFEKDKYILQGVTSWGLGXARPNKPGVYVRVSRFVTWIEGVMRNN

SEQ ID NO: 1392 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVXNRYEFLNGRVQSTELXAGHLAGGTDSXQGDSGGPLVXFEKDKYILQGVTSWGLGXARPNKPGVYVRVSRFVTWIEGVMRNN

SEQ ID NO: 1393 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVXNRYEFLNGRVQSTELXAGHLAGGTDSXQGDSGGPLVXFEKDKYILQGVTSWGLGXARPNKPGVYVRVSRFVTWIEGVMRNN

SEQ ID NO: 1394 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVXNRYEFLNGRVQSTELXAGHLAGGTDSCQGDSGGPLVXFEKDKYILQGVTSWGLGCARPNKPGVYVRVSRFVTWIEGVMRNN

SEQ ID NO: 1395 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVCNRYEFLNGRVQSTELCAGHLAGGTDSXQGDSGGPLVXFEKDKYILQGVTSWGLGXARPNKPGVYVRVSRFVTWIEGVMRNN

SEQ ID NO: 1396 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTECFITGWGETQGTFGAGLLKEAQLPVIENKVXNRYEFLNGRVQSTELXAGHLAGGTDSXQGDSGGPLVCFEKDKYILQGVTSWGLGXARPNKPGVYVRVSRFVTWIEGVMRNN

SEQ ID NO: 1397 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVXNRYEFLNGRVQSTELXAGHLAGGTDSXQGDSGGPLVXFEKDKYILQGVTSWGLGXARPNKPGVYVRVSRFVTWIEGVMRNN

SEQ ID NO: 1398 - protein, 230 aa, Artificial Sequence
  Synthesized sequence with two or more selenocysteine residues substituted for two or more cysteine residues
  VARIANT (1)...(230): Xaa = selenocysteine or cysteine
VVGGCVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVXNRYEFLNGRVQSTELXAGHLAGGTDSXQGDSGGPLVXFEKDKYILQGVTSWGLGXARPNKPGVYVRVSRFVTWIEGVMRNN

SEQ ID NO: 1399 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPACLPSPNYVVADRTEXFITGWGETQGTFGAGLLKEAQLPVIENKVXNRYEFLNGRVQSTELXAGHLAGGTDSXQGDSGGPLVXFEKDKYILQGVTSWGLGXARPNKPGVYVRVSRFVTWIEGVMRNN

SEQ ID NO: 1400 - protein, 230 aa, Artificial Sequence
  Synthesized sequence with two or more selenocysteine residues substituted for two or more cysteine residues
  VARIANT (1)...(230): Xaa = selenocysteine or cysteine
VVGGXVAHPHSWPWQVSLRTRFGMHFXGGTLISPEWVLTAAHXLEKSPRPSSYKVILGAHQEVNLEPHVQEIEVSRLFLEPTRKDIALLKLSSPAVITDKVIPAXLPSPNYVVADRTEXFITGWGETQGTFGAGLLKEAQLPVIENKVXNRYEFLNGRVQSTELXAGHLAGGTDSXQGDSGGPLVXFEKDKYILQGVTSWGLGXARPNKPGVYVRVSRFVTWIEGVMRNN

SEQ ID NO: 1401 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPECTLQENPFFSQPGAPILQCMGXCFSRAYPTPLRSKKTMLVQKNVTSESTCCVAKSYNRVTVMGGFKVENHTACHCSTCYYHKS

SEQ ID NO: 1402 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPEXTLQENPFFSQPGAPILQCMGCCFSRAYPTPLRSKKTMLVQKNVTSESTCXVAKSYNRVTVMGGFKVENHTACHCSTCYYHKS

SEQ ID NO: 1403 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPECTLQENPFFSQPGAPILQXMGCCFSRAYPTPLRSKKTMLVQKNVTSESTCCVAKSYNRVTVMGGFKVENHTAXHCSTCYYHKS

SEQ ID NO: 1404 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPECTLQENPFFSQPGAPILQCMGCXFSRAYPTPLRSKKTMLVQKNVTSESTCCVAKSYNRVTVMGGFKVENHTACHXSTCYYHKS

SEQ ID NO: 1405 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPECTLQENPFFSQPGAPILQCMGCCFSRAYPTPLRSKKTMLVQKNVTSESTXCVAKSYNRVTVMGGFKVENHTACHCSTXYYHKS

SEQ ID NO: 1406 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPEXTLQENPFFSQPGAPILQCMGXCFSRAYPTPLRSKKTMLVQKNVTSESTCXVAKSYNRVTVMGGFKVENHTACHCSTCYYHKS

SEQ ID NO: 1407 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPECTLQENPFFSQPGAPILQXMGXCFSRAYPTPLRSKKTMLVQKNVTSESTCCVAKSYNRVTVMGGFKVENHTAXHCSTCYYHKS

SEQ ID NO: 1408 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPECTLQENPFFSQPGAPILQCMGXXFSRAYPTPLRSKKTMLVQKNVTSESTCCVAKSYNRVTVMGGFKVENHTACHXSTCYYHKS

SEQ ID NO: 1409 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPECTLQENPFFSQPGAPILQCMGXCFSRAYPTPLRSKKTMLVQKNVTSESTXCVAKSYNRVTVMGGFKVENHTACHCSTXYYHKS

SEQ ID NO: 1410 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPEXTLQENPFFSQPGAPILQXMGCCFSRAYPTPLRSKKTMLVQKNVTSESTCXVAKSYNRVTVMGGFKVENHTAXHCSTCYYHKS

SEQ ID NO: 1411 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPEXTLQENPFFSQPGAPILQCMGCXFSRAYPTPLRSKKTMLVQKNVTSESTCXVAKSYNRVTVMGGFKVENHTACHXSTCYYHKS

SEQ ID NO: 1412 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPEXTLQENPFFSQPGAPILQCMGCCFSRAYPTPLRSKKTMLVQKNVTSESTXXVAKSYNRVTVMGGFKVENHTACHCSTXYYHKS

SEQ ID NO: 1413 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPECTLQENPFFSQPGAPILQXMGCXFSRAYPTPLRSKKTMLVQKNVTSESTCCVAKSYNRVTVMGGFKVENHTAXHXSTCYYHKS

SEQ ID NO: 1414 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPECTLQENPFFSQPGAPILQXMGCCFSRAYPTPLRSKKTMLVQKNVTSESTXCVAKSYNRVTVMGGFKVENHTAXHCSTXYYHKS

SEQ ID NO: 1415 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPECTLQENPFFSQPGAPILQCMGCXFSRAYPTPLRSKKTMLVQKNVTSESTXCVAKSYNRVTVMGGFKVENHTACHXSTXYYHKS

SEQ ID NO: 1416 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPEXTLQENPFFSQPGAPILQXMGXCFSRAYPTPLRSKKTMLVQKNVTSESTCXVAKSYNRVTVMGGFKVENHTAXHCSTCYYHKS

SEQ ID NO: 1417 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPEXTLQENPFFSQPGAPILQCMGXXFSRAYPTPLRSKKTMLVQKNVTSESTCXVAKSYNRVTVMGGFKVENHTACHXSTCYYHKS

SEQ ID NO: 1418 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPEXTLQENPFFSQPGAPILQCMGXCFSRAYPTPLRSKKTMLVQKNVTSESTXXVAKSYNRVTVMGGFKVENHTACHCSTXYYHKS

SEQ ID NO: 1419 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPECTLQENPFFSQPGAPILQXMGXXFSRAYPTPLRSKKTMLVQKNVTSESTCCVAKSYNRVTVMGGFKVENHTAXHXSTCYYHKS

SEQ ID NO: 1420 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPECTLQENPFFSQPGAPILQXMGXCFSRAYPTPLRSKKTMLVQKNVTSESTXCVAKSYNRVTVMGGFKVENHTAXHCSTXYYHKS

SEQ ID NO: 1421 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPECTLQENPFFSQPGAPILQCMGXXFSRAYPTPLRSKKTMLVQKNVTSESTXCVAKSYNRVTVMGGFKVENHTACHXSTXYYHKS

SEQ ID NO: 1422 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPEXTLQENPFFSQPGAPILQXMGCXFSRAYPTPLRSKKTMLVQKNVTSESTCXVAKSYNRVTVMGGFKVENHTAXHXSTCYYHKS

SEQ ID NO: 1423 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPEXTLQENPFFSQPGAPILQXMGCCFSRAYPTPLRSKKTMLVQKNVTSESTXXVAKSYNRVTVMGGFKVENHTAXHCSTXYYHKS

SEQ ID NO: 1424 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPECTLQENPFFSQPGAPILQXMGCXFSRAYPTPLRSKKTMLVQKNVTSESTXCVAKSYNRVTVMGGFKVENHTAXHXSTXYYHKS

SEQ ID NO: 1425 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPEXTLQENPFFSQPGAPILQXMGXXFSRAYPTPLRSKKTMLVQKNVTSESTCXVAKSYNRVTVMGGFKVENHTAXHXSTCYYHKS

SEQ ID NO: 1426 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPEXTLQENPFFSQPGAPILQXMGXCFSRAYPTPLRSKKTMLVQKNVTSESTXXVAKSYNRVTVMGGFKVENHTAXHCSTXYYHKS

SEQ ID NO: 1427 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPEXTLQENPFFSQPGAPILQCMGXXFSRAYPTPLRSKKTMLVQKNVTSESTXXVAKSYNRVTVMGGFKVENHTACHXSTXYYHKS

SEQ ID NO: 1428 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDXPECTLQENPFFSQPGAPILQXMGXXFSRAYPTPLRSKKTMLVQKNVTSESTXCVAKSYNRVTVMGGFKVENHTAXHXSTXYYHKS

SEQ ID NO: 1429 - protein, 92 aa, Artificial Sequence
  Synthesized sequence with two or more selenocysteine residues substituted for two or more cysteine residues
  VARIANT (1)...(92): Xaa = selenocysteine or cysteine
APDVQDCPEXTLQENPFFSQPGAPILQXMGCXFSRAYPTPLRSKKTMLVQKNVTSESTXXVAKSYNRVTVMGGFKVENHTAXHXSTXYYHKS

SEQ ID NO: 1430 - protein, 92 aa, Artificial Sequence; identical to SEQ ID NO: 1197
  Synthesized sequence with two or more selenocysteine residues substituted for two or more cysteine residues
  VARIANT (1)...(92): Xaa = selenocysteine or cysteine

SEQ ID NO: 1431 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYCLTINTTICAGYCMTRDINGKLFLPKYALSQDVXTYRDFIYRTVEIPGCPLHVAPYFSYPVALSCKCGKCNTDYSDCIHEAIKTNYCTKPQKSY

SEQ ID NO: 1432 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYCLTINTTICAGYCMTRDINGKLFLPKYALSQDVCTYRDFIYRTVEIPGXPLHVAPYFSYPVALSCKCGKCNTDYSDCIHEAIKTNYCTKPQKSY

SEQ ID NO: 1433 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYXLTINTTICAGYCMTRDINGKLFLPKYALSQDVCTYRDFIYRTVEIPGCPLHVAPYFSYPVALSCKCGKCNTDYSDCIHEAIKTNYXTKPQKSY

SEQ ID NO: 1434 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYCLTINTTIXAGYCMTRDINGKLFLPKYALSQDVCTYRDFIYRTVEIPGCPLHVAPYFSYPVALSXKCGKCNTDYSDCIHEAIKTNYCTKPQKSY

SEQ ID NO: 1435 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYCLTINTTICAGYXMTRDINGKLFLPKYALSQDVCTYRDFIYRTVEIPGCPLHVAPYFSYPVALSCKXGKCNTDYSDCIHEAIKTNYCTKPQKSY

SEQ ID NO: 1436 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYCLTINTTICAGYCMTRDINGKLFLPKYALSQDVCTYRDFIYRTVEIPGCPLHVAPYFSYPVALSCKCGKXNTDYSDXIHEAIKTNYCTKPQKSY

SEQ ID NO: 1437 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYCLTINTTICAGYCMTRDINGKLFLPKYALSQDVXTYRDFIYRTVEIPGXPLHVAPYFSYPVALSCKCGKCNTDYSDCIHEAIKTNYCTKPQKSY

SEQ ID NO: 1438 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYXLTINTTICAGYCMTRDINGKLFLPKYALSQDVXTYRDFIYRTVEIPGCPLHVAPYFSYPVALSCKCGKCNTDYSDCIHEAIKTNYXTKPQKSY

SEQ ID NO: 1439 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYCLTINTTIXAGYCMTRDINGKLFLPKYALSQDVXTYRDFIYRTVEIPGCPLHVAPYFSYPVALSXKCGKCNTDYSDCIHEAIKTNYCTKPQKSY

SEQ ID NO: 1440 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYCLTINTTICAGYXMTRDINGKLFLPKYALSQDVXTYRDFIYRTVEIPGCPLHVAPYFSYPVALSCKXGKCNTDYSDCIHEAIKTNYCTKPQKSY

SEQ ID NO: 1441 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYCLTINTTICAGYCMTRDINGKLFLPKYALSQDVXTYRDFIYRTVEIPGCPLHVAPYFSYPVALSCKCGKXNTDYSDXIHEAIKTNYCTKPQKSY

SEQ ID NO: 1442 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYXLTINTTICAGYCMTRDINGKLFLPKYALSQDVCTYRDFIYRTVEIPGXPLHVAPYFSYPVALSCKCGKCNTDYSDCIHEAIKTNYXTKPQKSY

SEQ ID NO: 1443 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYCLTINTTIXAGYCMTRDINGKLFLPKYALSQDVCTYRDFIYRTVEIPGXPLHVAPYFSYPVALSXKCGKCNTDYSDCIHEAIKTNYCTKPQKSY

SEQ ID NO: 1444 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYCLTINTTICAGYXMTRDINGKLFLPKYALSQDVCTYRDFIYRTVEIPGXPLHVAPYFSYPVALSCKXGKCNTDYSDCIHEAIKTNYCTKPQKSY

SEQ ID NO: 1445 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYCLTINTTICAGYCMTRDINGKLFLPKYALSQDVCTYRDFIYRTVEIPGXPLHVAPYFSYPVALSCKCGKXNTDYSDXIHEAIKTNYCTKPQKSY

SEQ ID NO: 1446 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYXLTINTTIXAGYCMTRDINGKLFLPKYALSQDVCTYRDFIYRTVEIPGCPLHVAPYFSYPVALSXKCGKCNTDYSDCIHEAIKTNYXTKPQKSY

SEQ ID NO: 1447 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYXLTINTTICAGYXMTRDINGKLFLPKYALSQDVCTYRDFIYRTVEIPGCPLHVAPYFSYPVALSCKXGKCNTDYSDCIHEAIKTNYXTKPQKSY

SEQ ID NO: 1448 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYXLTINTTICAGYCMTRDINGKLFLPKYALSQDVCTYRDFIYRTVEIPGCPLHVAPYFSYPVALSCKCGKXNTDYSDXIHEAIKTNYXTKPQKSY

SEQ ID NO: 1449 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYCLTINTTIXAGYXMTRDINGKLFLPKYALSQDVCTYRDFIYRTVEIPGCPLHVAPYFSYPVALSXKXGKCNTDYSDCIHEAIKTNYCTKPQKSY

SEQ ID NO: 1450 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYCLTINTTIXAGYCMTRDINGKLFLPKYALSQDVCTYRDFIYRTVEIPGCPLHVAPYFSYPVALSXKCGKXNTDYSDXIHEAIKTNYCTKPQKSY

SEQ ID NO: 1451 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYCLTINTTICAGYXMTRDINGKLFLPKYALSQDVCTYRDFIYRTVEIPGCPLHVAPYFSYPVALSCKXGKXNTDYSDXIHEAIKTNYCTKPQKSY

SEQ ID NO: 1452 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYXLTINTTICAGYCMTRDINGKLFLPKYALSQDVXTYRDFIYRTVEIPGXPLHVAPYFSYPVALSCKCGKCNTDYSDCIHEAIKTNYXTKPQKSY

SEQ ID NO: 1453 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYCLTINTTIXAGYCMTRDINGKLFLPKYALSQDVXTYRDFIYRTVEIPGXPLHVAPYFSYPVALSXKCGKCNTDYSDCIHEAIKTNYCTKPQKSY

SEQ ID NO: 1454 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYCLTINTTICAGYXMTRDINGKLFLPKYALSQDVXTYRDFIYRTVEIPGXPLHVAPYFSYPVALSCKXGKCNTDYSDCIHEAIKTNYCTKPQKSY

SEQ ID NO: 1455 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYCLTINTTICAGYCMTRDINGKLFLPKYALSQDVXTYRDFIYRTVEIPGXPLHVAPYFSYPVALSCKCGKXNTDYSDXIHEAIKTNYCTKPQKSY

SEQ ID NO: 1456 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYXLTINTTIXAGYCMTRDINGKLFLPKYALSQDVXTYRDFIYRTVEIPGCPLHVAPYFSYPVALSXKCGKCNTDYSDCIHEAIKTNYXTKPQKSY

SEQ ID NO: 1457 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYXLTINTTICAGYXMTRDINGKLFLPKYALSQDVXTYRDFIYRTVEIPGCPLHVAPYFSYPVALSCKXGKCNTDYSDCIHEAIKTNYXTKPQKSY

SEQ ID NO: 1458 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYXLTINTTICAGYCMTRDINGKLFLPKYALSQDVXTYRDFIYRTVEIPGCPLHVAPYFSYPVALSCKCGKXNTDYSDXIHEAIKTNYXTKPQKSY

SEQ ID NO: 1459 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYCLTINTTIXAGYXMTRDINGKLFLPKYALSQDVXTYRDFIYRTVEIPGCPLHVAPYFSYPVALSXKXGKCNTDYSDCIHEAIKTNYCTKPQKSY

SEQ ID NO: 1460 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYCLTINTTIXAGYCMTRDINGKLFLPKYALSQDVXTYRDFIYRTVEIPGCPLHVAPYFSYPVALSXKCGKXNTDYSDXIHEAIKTNYCTKPQKSY

SEQ ID NO: 1461 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYCLTINTTICAGYXMTRDINGKLFLPKYALSQDVXTYRDFIYRTVEIPGCPLHVAPYFSYPVALSCKXGKXNTDYSDXIHEAIKTNYCTKPQKSY

SEQ ID NO: 1462 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYXLTINTTIXAGYCMTRDINGKLFLPKYALSQDVCTYRDFIYRTVEIPGXPLHVAPYFSYPVALSXKCGKCNTDYSDCIHEAIKTNYXTKPQKSY

SEQ ID NO: 1463 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYXLTINTTICAGYXMTRDINGKLFLPKYALSQDVCTYRDFIYRTVEIPGXPLHVAPYFSYPVALSCKXGKCNTDYSDCIHEAIKTNYXTKPQKSY

SEQ ID NO: 1464 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYXLTINTTICAGYCMTRDINGKLFLPKYALSQDVCTYRDFIYRTVEIPGXPLHVAPYFSYPVALSCKCGKXNTDYSDXIHEAIKTNYXTKPQKSY

SEQ ID NO: 1465 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYCLTINTTIXAGYXMTRDINGKLFLPKYALSQDVCTYRDFIYRTVEIPGXPLHVAPYFSYPVALSXKXGKCNTDYSDCIHEAIKTNYCTKPQKSY

SEQ ID NO: 1466 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYCLTINTTIXAGYCMTRDINGKLFLPKYALSQDVCTYRDFIYRTVEIPGXPLHVAPYFSYPVALSXKCGKXNTDYSDXIHEAIKTNYCTKPQKSY

SEQ ID NO: 1467 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYCLTINTTICAGYXMTRDINGKLFLPKYALSQDVCTYRDFIYRTVEIPGXPLHVAPYFSYPVALSCKXGKXNTDYSDXIHEAIKTNYCTKPQKSY

SEQ ID NO: 1468 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYXLTINTTIXAGYXMTRDINGKLFLPKYALSQDVCTYRDFIYRTVEIPGCPLHVAPYFSYPVALSXKXGKCNTDYSDCIHEAIKTNYXTKPQKSY

SEQ ID NO: 1469 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYXLTINTTIXAGYCMTRDINGKLFLPKYALSQDVCTYRDFIYRTVEIPGCPLHVAPYFSYPVALSXKCGKXNTDYSDXIHEAIKTNYXTKPQKSY

SEQ ID NO: 1470 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYXLTINTTICAGYXMTRDINGKLFLPKYALSQDVCTYRDFIYRTVEIPGCPLHVAPYFSYPVALSCKXGKXNTDYSDXIHEAIKTNYXTKPQKSY

SEQ ID NO: 1471 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYCLTINTTIXAGYXMTRDINGKLFLPKYALSQDVCTYRDFIYRTVEIPGCPLHVAPYFSYPVALSXKXGKXNTDYSDXIHEAIKTNYCTKPQKSY

SEQ ID NO: 1472 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYXLTINTTIXAGYCMTRDINGKLFLPKYALSQDVXTYRDFIYRTVEIPGXPLHVAPYFSYPVALSXKCGKCNTDYSDCIHEAIKTNYXTKPQKSY

SEQ ID NO: 1473 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYXLTINTTICAGYXMTRDINGKLFLPKYALSQDVXTYRDFIYRTVEIPGXPLHVAPYFSYPVALSCKXGKCNTDYSDCIHEAIKTNYXTKPQKSY

SEQ ID NO: 1474 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYXLTINTTICAGYCMTRDINGKLFLPKYALSQDVXTYRDFIYRTVEIPGXPLHVAPYFSYPVALSCKCGKXNTDYSDXIHEAIKTNYXTKPQKSY

SEQ ID NO: 1475 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYCLTINTTIXAGYXMTRDINGKLFLPKYALSQDVXTYRDFIYRTVEIPGXPLHVAPYFSYPVALSXKXGKCNTDYSDCIHEAIKTNYCTKPQKSY

SEQ ID NO: 1476 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYCLTINTTIXAGYCMTRDINGKLFLPKYALSQDVXTYRDFIYRTVEIPGXPLHVAPYFSYPVALSXKCGKXNTDYSDXIHEAIKTNYCTKPQKSY

SEQ ID NO: 1477 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYCLTINTTICAGYXMTRDINGKLFLPKYALSQDVXTYRDFIYRTVEIPGXPLHVAPYFSYPVALSCKXGKXNTDYSDXIHEAIKTNYCTKPQKSY

SEQ ID NO: 1478 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYXLTINTTIXAGYXMTRDINGKLFLPKYALSQDVXTYRDFIYRTVEIPGCPLHVAPYFSYPVALSXKXGKCNTDYSDCIHEAIKTNYXTKPQKSY

SEQ ID NO: 1479 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYXLTINTTIXAGYCMTRDINGKLFLPKYALSQDVXTYRDFIYRTVEIPGCPLHVAPYFSYPVALSXKCGKXNTDYSDXIHEAIKTNYXTKPQKSY

SEQ ID NO: 1480 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYXLTINTTICAGYXMTRDINGKLFLPKYALSQDVXTYRDFIYRTVEIPGCPLHVAPYFSYPVALSCKXGKXNTDYSDXIHEAIKTNYXTKPQKSY

SEQ ID NO: 1481 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYCLTINTTIXAGYXMTRDINGKLFLPKYALSQDVXTYRDFIYRTVEIPGCPLHVAPYFSYPVALSXKXGKXNTDYSDXIHEAIKTNYCTKPQKSY

SEQ ID NO: 1482 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYXLTINTTIXAGYXMTRDINGKLFLPKYALSQDVCTYRDFIYRTVEIPGXPLHVAPYFSYPVALSXKXGKCNTDYSDCIHEAIKTNYXTKPQKSY

SEQ ID NO: 1483 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYXLTINTTIXAGYCMTRDINGKLFLPKYALSQDVCTYRDFIYRTVEIPGXPLHVAPYFSYPVALSXKCGKXNTDYSDXIHEAIKTNYXTKPQKSY

SEQ ID NO: 1484 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYXLTINTTICAGYXMTRDINGKLFLPKYALSQDVCTYRDFIYRTVEIPGXPLHVAPYFSYPVALSCKXGKXNTDYSDXIHEAIKTNYXTKPQKSY

SEQ ID NO: 1485 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYCLTINTTIXAGYXMTRDINGKLFLPKYALSQDVCTYRDFIYRTVEIPGXPLHVAPYFSYPVALSXKXGKXNTDYSDXIHEAIKTNYCTKPQKSY

SEQ ID NO: 1486 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERRECAYXLTINTTIXAGYXMTRDINGKLFLPKYALSQDVCTYRDFIYRTVEIPGCPLHVAPYFSYPVALSXKXGKXNTDYSDXIHEAIKTNYXTKPQKSY

SEQ ID NO: 1487 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYXLTINTTIXAGYXMTRDINGKLFLPKYALSQDVXTYRDFIYRTVEIPGXPLHVAPYFSYPVALSXKXGKCNTDYSDCIHEAIKTNYXTKPQKSY

SEQ ID NO: 1488 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYXLTINTTIXAGYCMTRDINGKLFLPKYALSQDVXTYRDFIYRTVEIPGXPLHVAPYFSYPVALSXKCGKXNTDYSDXIHEAIKTNYXTKPQKSY

SEQ ID NO: 1489 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYXLTINTTICAGYXMTRDINGKLFLPKYALSQDVXTYRDFIYRTVEIPGXPLHVAPYFSYPVALSCKXGKXNTDYSDXIHEAIKTNYXTKPQKSY

SEQ ID NO: 1490 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYCLTINTTIXAGYXMTRDINGKLFLPKYALSQDVXTYRDFIYRTVEIPGXPLHVAPYFSYPVALSXKXGKXNTDYSDXIHEAIKTNYCTKPQKSY

SEQ ID NO: 1491 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERRECAYXLTINTTIXAGYXMTRDINGKLFLPKYALSQDVXTYRDFIYRTVEIPGCPLHVAPYFSYPVALSXKXGKXNTDYSDXIHEAIKTNYXTKPQKSY

SEQ ID NO: 1492 - protein, 112 aa, Artificial Sequence
  Synthesized sequence with two or more selenocysteine residues substituted for two or more cysteine residues
  VARIANT (1)...(112): Xaa = selenocysteine or cysteine
FCIPTEYTMHIERREXAYXLTINTTIXAGYXMTRDINGKLFLPKYALSQDVCTYRDFIYRTVEIPGXPLHVAPYFSYPVALSXKXGKXNTDYSDXIHEAIKTNYXTKPQKSY

SEQ ID NO: 1493 - protein, 112 aa, Artificial Sequence
  Synthesized sequence with two or more selenocysteine residues substituted for two or more cysteine residues
  VARIANT (1)...(112): Xaa = selenocysteine or cysteine
FXIPTEYTMHIERREXAYXLTINTTIXAGYXMTRDINGKLFLPKYALSQDVXTYRDFIYRTVEIPGXPLHVAPYFSYPVALSXKXGKXNTDYSDXIHEAIKTNYXTKPQKSY

SEQ ID NO: 1494 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWCAGYCYTRDLVYKDPARPKIQKTXTFKELVYETVRVPGCAHHADSLYTYPVATQCHCGKCDSDSTDCTVRGLGPSYCSFGEMKE

SEQ ID NO: 1495 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWCAGYCYTRDLVYKDPARPKIQKTCTFKELVYETVRVPGXAHHADSLYTYPVATQCHCGKCDSDSTDCTVRGLGPSYCSFGEMKE

SEQ ID NO: 1496 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWCAGYCYTRDLVYKDPARPKIQKTCTFKELVYETVRVPGCAHHADSLYTYPVATQCHCGKCDSDSTDCTVRGLGPSYXSFGEMKE

SEQ ID NO: 1497 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWXAGYCYTRDLVYKDPARPKIQKTCTFKELVYETVRVPGCAHHADSLYTYPVATQXHCGKCDSDSTDCTVRGLGPSYCSFGEMKE

SEQ ID NO: 1498 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWCAGYXYTRDLVYKDPARPKIQKTCTFKELVYETVRVPGCAHHADSLYTYPVATQCHXGKCDSDSTDCTVRGLGPSYCSFGEMKE

SEQ ID NO: 1499 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWCAGYCYTRDLVYKDPARPKIQKTCTFKELVYETVRVPGCAHHADSLYTYPVATQCHCGKXDSDSTDXTVRGLGPSYCSFGEMKE

SEQ ID NO: 1500 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWCAGYCYTRDLVYKDPARPKIQKTXTFKELVYETVRVPGXAHHADSLYTYPVATQCHCGKCDSDSTDCTVRGLGPSYCSFGEMKE

SEQ ID NO: 1501 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWCAGYCYTRDLVYKDPARPKIQKTXTFKELVYETVRVPGCAHHADSLYTYPVATQCHCGKCDSDSTDCTVRGLGPSYXSFGEMKE

SEQ ID NO: 1502 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWXAGYCYTRDLVYKDPARPKIQKTXTFKELVYETVRVPGCAHHADSLYTYPVATQXHCGKCDSDSTDCTVRGLGPSYCSFGEMKE

SEQ ID NO: 1503 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWCAGYXYTRDLVYKDPARPKIQKTXTFKELVYETVRVPGCAHHADSLYTYPVATQCHXGKCDSDSTDCTVRGLGPSYCSFGEMKE

SEQ ID NO: 1504 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWCAGYCYTRDLVYKDPARPKIQKTXTFKELVYETVRVPGCAHHADSLYTYPVATQCHCGKXDSDSTDXTVRGLGPSYCSFGEMKE

SEQ ID NO: 1505 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWCAGYCYTRDLVYKDPARPKIQKTCTFKELVYETVRVPGXAHHADSLYTYPVATQCHCGKCDSDSTDCTVRGLGPSYXSFGEMKE

SEQ ID NO: 1506 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWXAGYCYTRDLVYKDPARPKIQKTCTFKELVYETVRVPGXAHHADSLYTYPVATQXHCGKCDSDSTDCTVRGLGPSYCSFGEMKE

SEQ ID NO: 1507 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWCAGYXYTRDLVYKDPARPKIQKTCTFKELVYETVRVPGXAHHADSLYTYPVATQCHXGKCDSDSTDCTVRGLGPSYCSFGEMKE

SEQ ID NO: 1508 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWCAGYCYTRDLVYKDPARPKIQKTCTFKELVYETVRVPGXAHHADSLYTYPVATQCHCGKXDSDSTDXTVRGLGPSYCSFGEMKE

SEQ ID NO: 1509 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWXAGYCYTRDLVYKDPARPKIQKTCTFKELVYETVRVPGCAHHADSLYTYPVATQXHCGKCDSDSTDCTVRGLGPSYXSFGEMKE

SEQ ID NO: 1510 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWCAGYXYTRDLVYKDPARPKIQKTCTFKELVYETVRVPGCAHHADSLYTYPVATQCHXGKCDSDSTDCTVRGLGPSYXSFGEMKE

SEQ ID NO: 1511 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWCAGYCYTRDLVYKDPARPKIQKTCTFKELVYETVRVPGCAHHADSLYTYPVATQCHCGKXDSDSTDXTVRGLGPSYXSFGEMKE

SEQ ID NO: 1512 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWXAGYXYTRDLVYKDPARPKIQKTCTFKELVYETVRVPGCAHHADSLYTYPVATQXHXGKCDSDSTDCTVRGLGPSYCSFGEMKE

SEQ ID NO: 1513 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWXAGYCYTRDLVYKDPARPKIQKTCTFKELVYETVRVPGCAHHADSLYTYPVATQXHCGKXDSDSTDXTVRGLGPSYCSFGEMKE

SEQ ID NO: 1514 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWCAGYXYTRDLVYKDPARPKIQKTCTFKELVYETVRVPGCAHHADSLYTYPVATQCHXGKXDSDSTDXTVRGLGPSYCSFGEMKE

SEQ ID NO: 1515 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWCAGYCYTRDLVYKDPARPKIQKTXTFKELVYETVRVPGXAHHADSLYTYPVATQCHCGKCDSDSTDCTVRGLGPSYXSFGEMKE

SEQ ID NO: 1516 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWXAGYCYTRDLVYKDPARPKIQKTXTFKELVYETVRVPGXAHHADSLYTYPVATQXHCGKCDSDSTDCTVRGLGPSYCSFGEMKE

SEQ ID NO: 1517 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWCAGYXYTRDLVYKDPARPKIQKTXTFKELVYETVRVPGXAHHADSLYTYPVATQCHXGKCDSDSTDCTVRGLGPSYCSFGEMKE

SEQ ID NO: 1518 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWCAGYCYTRDLVYKDPARPKIQKTXTFKELVYETVRVPGXAHHADSLYTYPVATQCHCGKXDSDSTDXTVRGLGPSYCSFGEMKE

SEQ ID NO: 1519 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWXAGYCYTRDLVYKDPARPKIQKTXTFKELVYETVRVPGCAHHADSLYTYPVATQXHCGKCDSDSTDCTVRGLGPSYXSFGEMKE

SEQ ID NO: 1520 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWCAGYXYTRDLVYKDPARPKIQKTXTFKELVYETVRVPGCAHHADSLYTYPVATQCHXGKCDSDSTDCTVRGLGPSYXSFGEMKE

SEQ ID NO: 1521 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWCAGYCYTRDLVYKDPARPKIQKTXTFKELVYETVRVPGCAHHADSLYTYPVATQCHCGKXDSDSTDXTVRGLGPSYXSFGEMKE

SEQ ID NO: 1522 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWXAGYXYTRDLVYKDPARPKIQKTXTFKELVYETVRVPGCAHHADSLYTYPVATQXHXGKCDSDSTDCTVRGLGPSYCSFGEMKE

SEQ ID NO: 1523 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWXAGYCYTRDLVYKDPARPKIQKTXTFKELVYETVRVPGCAHHADSLYTYPVATQXHCGKXDSDSTDXTVRGLGPSYCSFGEMKE

SEQ ID NO: 1524 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWCAGYXYTRDLVYKDPARPKIQKTXTFKELVYETVRVPGCAHHADSLYTYPVATQCHXGKXDSDSTDXTVRGLGPSYCSFGEMKE

SEQ ID NO: 1525 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWXAGYCYTRDLVYKDPARPKIQKTCTFKELVYETVRVPGXAHHADSLYTYPVATQXHCGKCDSDSTDCTVRGLGPSYXSFGEMKE

SEQ ID NO: 1526 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWCAGYXYTRDLVYKDPARPKIQKTCTFKELVYETVRVPGXAHHADSLYTYPVATQCHXGKCDSDSTDCTVRGLGPSYXSFGEMKE

SEQ ID NO: 1527 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWCAGYCYTRDLVYKDPARPKIQKTCTFKELVYETVRVPGXAHHADSLYTYPVATQCHCGKXDSDSTDXTVRGLGPSYXSFGEMKE

SEQ ID NO: 1528 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWXAGYXYTRDLVYKDPARPKIQKTCTFKELVYETVRVPGXAHHADSLYTYPVATQXHXGKCDSDSTDCTVRGLGPSYCSFGEMKE

SEQ ID NO: 1529 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWXAGYCYTRDLVYKDPARPKIQKTCTFKELVYETVRVPGXAHHADSLYTYPVATQXHCGKXDSDSTDXTVRGLGPSYCSFGEMKE

SEQ ID NO: 1530 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWCAGYXYTRDLVYKDPARPKIQKTCTFKELVYETVRVPGXAHHADSLYTYPVATQCHXGKXDSDSTDXTVRGLGPSYCSFGEMKE

SEQ ID NO: 1531 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWXAGYXYTRDLVYKDPARPKIQKTCTFKELVYETVRVPGCAHHADSLYTYPVATQXHXGKCDSDSTDCTVRGLGPSYXSFGEMKE

SEQ ID NO: 1532 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWXAGYCYTRDLVYKDPARPKIQKTCTFKELVYETVRVPGCAHHADSLYTYPVATQXHCGKXDSDSTDXTVRGLGPSYXSFGEMKE

SEQ ID NO: 1533 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWCAGYXYTRDLVYKDPARPKIQKTCTFKELVYETVRVPGCAHHADSLYTYPVATQCHXGKXDSDSTDXTVRGLGPSYXSFGEMKE

SEQ ID NO: 1534 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWXAGYXYTRDLVYKDPARPKIQKTCTFKELVYETVRVPGCAHHADSLYTYPVATQXHXGKXDSDSTDXTVRGLGPSYCSFGEMKE

SEQ ID NO: 1535 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWXAGYCYTRDLVYKDPARPKIQKTXTFKELVYETVRVPGXAHHADSLYTYPVATQXHCGKCDSDSTDCTVRGLGPSYXSFGEMKE

SEQ ID NO: 1536 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWCAGYXYTRDLVYKDPARPKIQKTXTFKELVYETVRVPGXAHHADSLYTYPVATQCHXGKCDSDSTDCTVRGLGPSYXSFGEMKE

SEQ ID NO: 1537 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWCAGYCYTRDLVYKDPARPKIQKTXTFKELVYETVRVPGXAHHADSLYTYPVATQCHCGKXDSDSTDXTVRGLGPSYXSFGEMKE

SEQ ID NO: 1538 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWXAGYXYTRDLVYKDPARPKIQKTXTFKELVYETVRVPGXAHHADSLYTYPVATQXHXGKCDSDSTDCTVRGLGPSYCSFGEMKE

SEQ ID NO: 1539 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWXAGYCYTRDLVYKDPARPKIQKTXTFKELVYETVRVPGXAHHADSLYTYPVATQXHCGKXDSDSTDXTVRGLGPSYCSFGEMKE

SEQ ID NO: 1540 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWCAGYXYTRDLVYKDPARPKIQKTXTFKELVYETVRVPGXAHHADSLYTYPVATQCHXGKXDSDSTDXTVRGLGPSYCSFGEMKE

SEQ ID NO: 1541 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWXAGYXYTRDLVYKDPARPKIQKTXTFKELVYETVRVPGCAHHADSLYTYPVATQXHXGKCDSDSTDCTVRGLGPSYXSFGEMKE

SEQ ID NO: 1542 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWXAGYCYTRDLVYKDPARPKIQKTXTFKELVYETVRVPGCAHHADSLYTYPVATQXHCGKXDSDSTDXTVRGLGPSYXSFGEMKE

SEQ ID NO: 1543 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWCAGYXYTRDLVYKDPARPKIQKTXTFKELVYETVRVPGCAHHADSLYTYPVATQCHXGKXDSDSTDXTVRGLGPSYXSFGEMKE

SEQ ID NO: 1544 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWXAGYXYTRDLVYKDPARPKIQKTXTFKELVYETVRVPGCAHHADSLYTYPVATQXHXGKXDSDSTDXTVRGLGPSYCSFGEMKE

SEQ ID NO: 1545 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWXAGYXYTRDLVYKDPARPKIQKTCTFKELVYETVRVPGXAHHADSLYTYPVATQXHXGKCDSDSTDCTVRGLGPSYXSFGEMKE

SEQ ID NO: 1546 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWXAGYCYTRDLVYKDPARPKIQKTCTFKELVYETVRVPGXAHHADSLYTYPVATQXHCGKXDSDSTDXTVRGLGPSYXSFGEMKE

SEQ ID NO: 1547 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWCAGYXYTRDLVYKDPARPKIQKTCTFKELVYETVRVPGXAHHADSLYTYPVATQCHXGKXDSDSTDXTVRGLGPSYXSFGEMKE

SEQ ID NO: 1548 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWXAGYXYTRDLVYKDPARPKIQKTCTFKELVYETVRVPGXAHHADSLYTYPVATQXHXGKXDSDSTDXTVRGLGPSYCSFGEMKE

SEQ ID NO: 1549 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWXAGYXYTRDLVYKDPARPKIQKTCTFKELVYETVRVPGCAHHADSLYTYPVATQXHXGKXDSDSTDXTVRGLGPSYXSFGEMKE

SEQ ID NO: 1550 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWXAGYXYTRDLVYKDPARPKIQKTXTFKELVYETVRVPGXAHHADSLYTYPVATQXHXGKCDSDSTDCTVRGLGPSYXSFGEMKE

SEQ ID NO: 1551 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWXAGYCYTRDLVYKDPARPKIQKTXTFKELVYETVRVPGXAHHADSLYTYPVATQXHCGKXDSDSTDXTVRGLGPSYXSFGEMKE

SEQ ID NO: 1552 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWCAGYXYTRDLVYKDPARPKIQKTXTFKELVYETVRVPGXAHHADSLYTYPVATQCHXGKXDSDSTDXTVRGLGPSYXSFGEMKE

SEQ ID NO: 1553 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWXAGYXYTRDLVYKDPARPKIQKTXTFKELVYETVRVPGXAHHADSLYTYPVATQXHXGKXDSDSTDXTVRGLGPSYCSFGEMKE

SEQ ID NO: 1554 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWXAGYXYTRDLVYKDPARPKIQKTXTFKELVYETVRVPGCAHHADSLYTYPVATQXHXGKXDSDSTDXTVRGLGPSYXSFGEMKE

SEQ ID NO: 1555 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWXAGYXYTRDLVYKDPARPKIQKTCTFKELVYETVRVPGXAHHADSLYTYPVATQXHXGKXDSDSTDXTVRGLGPSYXSFGEMKE

SEQ ID NO: 1556 - protein, 111 aa, Artificial Sequence; identical to SEQ ID NO: 1198
  Synthesized sequence with two or more selenocysteine residues substituted for two or more cysteine residues
  VARIANT (1)...(111): Xaa = selenocysteine or cysteine

SEQ ID NO: 1557 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWCAGYCYTRDLVYKDPARPKIQKTXTPKELVYETVRVPGCAHHADSLYTYPVATQCHCGKCDSDSTDCTVRGLGPSYCSFGEMKE

SEQ ID NO: 1558 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWCAGYCYTRDLVYKDPARPKIQKTCTPKELVYETVRVPGXAHHADSLYTYPVATQCHCGKCDSDSTDCTVRGLGPSYCSFGEMKE

SEQ ID NO: 1559 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWCAGYCYTRDLVYKDPARPKIQKTCTPKELVYETVRVPGCAHHADSLYTYPVATQCHCGKCDSDSTDCTVRGLGPSYXSFGEMKE

SEQ ID NO: 1560 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWXAGYCYTRDLVYKDPARPKIQKTCTPKELVYETVRVPGCAHHADSLYTYPVATQXHCGKCDSDSTDCTVRGLGPSYCSFGEMKE

SEQ ID NO: 1561 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWCAGYXYTRDLVYKDPARPKIQKTCTPKELVYETVRVPGCAHHADSLYTYPVATQCHXGKCDSDSTDCTVRGLGPSYCSFGEMKE

SEQ ID NO: 1562 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWCAGYCYTRDLVYKDPARPKIQKTCTPKELVYETVRVPGCAHHADSLYTYPVATQCHCGKXDSDSTDXTVRGLGPSYCSFGEMKE

SEQ ID NO: 1563 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWCAGYCYTRDLVYKDPARPKIQKTXTPKELVYETVRVPGXAHHADSLYTYPVATQCHCGKCDSDSTDCTVRGLGPSYCSFGEMKE

SEQ ID NO: 1564 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWCAGYCYTRDLVYKDPARPKIQKTXTPKELVYETVRVPGCAHHADSLYTYPVATQCHCGKCDSDSTDCTVRGLGPSYXSFGEMKE

SEQ ID NO: 1565 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWXAGYCYTRDLVYKDPARPKIQKTXTPKELVYETVRVPGCAHHADSLYTYPVATQXHCGKCDSDSTDCTVRGLGPSYCSFGEMKE

SEQ ID NO: 1566 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWCAGYXYTRDLVYKDPARPKIQKTXTPKELVYETVRVPGCAHHADSLYTYPVATQCHXGKCDSDSTDCTVRGLGPSYCSFGEMKE

SEQ ID NO: 1567 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWCAGYCYTRDLVYKDPARPKIQKTXTPKELVYETVRVPGCAHHADSLYTYPVATQCHCGKXDSDSTDXTVRGLGPSYCSFGEMKE

SEQ ID NO: 1568 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWCAGYCYTRDLVYKDPARPKIQKTCTPKELVYETVRVPGXAHHADSLYTYPVATQCHCGKCDSDSTDCTVRGLGPSYXSFGEMKE

SEQ ID NO: 1569 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWXAGYCYTRDLVYKDPARPKIQKTCTPKELVYETVRVPGXAHHADSLYTYPVATQXHCGKCDSDSTDCTVRGLGPSYCSFGEMKE

SEQ ID NO: 1570 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWCAGYXYTRDLVYKDPARPKIQKTCTPKELVYETVRVPGXAHHADSLYTYPVATQCHXGKCDSDSTDCTVRGLGPSYCSFGEMKE

SEQ ID NO: 1571 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWCAGYCYTRDLVYKDPARPKIQKTCTPKELVYETVRVPGXAHHADSLYTYPVATQCHCGKXDSDSTDXTVRGLGPSYCSFGEMKE

SEQ ID NO: 1572 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWXAGYCYTRDLVYKDPARPKIQKTCTPKELVYETVRVPGCAHHADSLYTYPVATQXHCGKCDSDSTDCTVRGLGPSYXSFGEMKE

SEQ ID NO: 1573 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWCAGYXYTRDLVYKDPARPKIQKTCTPKELVYETVRVPGCAHHADSLYTYPVATQCHXGKCDSDSTDCTVRGLGPSYXSFGEMKE

SEQ ID NO: 1574 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWCAGYCYTRDLVYKDPARPKIQKTCTPKELVYETVRVPGCAHHADSLYTYPVATQCHCGKXDSDSTDXTVRGLGPSYXSFGEMKE

SEQ ID NO: 1575 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWXAGYXYTRDLVYKDPARPKIQKTCTPKELVYETVRVPGCAHHADSLYTYPVATQXHXGKCDSDSTDCTVRGLGPSYCSFGEMKE

SEQ ID NO: 1576 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWXAGYCYTRDLVYKDPARPKIQKTCTPKELVYETVRVPGCAHHADSLYTYPVATQXHCGKXDSDSTDXTVRGLGPSYCSFGEMKE

SEQ ID NO: 1577 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWCAGYXYTRDLVYKDPARPKIQKTCTPKELVYETVRVPGCAHHADSLYTYPVATQCHXGKXDSDSTDXTVRGLGPSYCSFGEMKE

SEQ ID NO: 1578 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWCAGYCYTRDLVYKDPARPKIQKTXTPKELVYETVRVPGXAHHADSLYTYPVATQCHCGKCDSDSTDCTVRGLGPSYXSFGEMKE

SEQ ID NO: 1579 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWXAGYCYTRDLVYKDPARPKIQKTXTPKELVYETVRVPGXAHHADSLYTYPVATQXHCGKCDSDSTDCTVRGLGPSYCSFGEMKE

SEQ ID NO: 1580 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWCAGYXYTRDLVYKDPARPKIQKTXTPKELVYETVRVPGXAHHADSLYTYPVATQCHXGKCDSDSTDCTVRGLGPSYCSFGEMKE

SEQ ID NO: 1581 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWCAGYCYTRDLVYKDPARPKIQKTXTPKELVYETVRVPGXAHHADSLYTYPVATQCHCGKXDSDSTDXTVRGLGPSYCSFGEMKE

SEQ ID NO: 1582 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWXAGYCYTRDLVYKDPARPKIQKTXTPKELVYETVRVPGCAHHADSLYTYPVATQXHCGKCDSDSTDCTVRGLGPSYXSFGEMKE

SEQ ID NO: 1583 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWCAGYXYTRDLVYKDPARPKIQKTXTPKELVYETVRVPGCAHHADSLYTYPVATQCHXGKCDSDSTDCTVRGLGPSYXSFGEMKE

SEQ ID NO: 1584 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWCAGYCYTRDLVYKDPARPKIQKTXTPKELVYETVRVPGCAHHADSLYTYPVATQCHCGKXDSDSTDXTVRGLGPSYXSFGEMKE

SEQ ID NO: 1585 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWXAGYXYTRDLVYKDPARPKIQKTXTPKELVYETVRVPGCAHHADSLYTYPVATQXHXGKCDSDSTDCTVRGLGPSYCSFGEMKE

SEQ ID NO: 1586 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWXAGYCYTRDLVYKDPARPKIQKTXTPKELVYETVRVPGCAHHADSLYTYPVATQXHCGKXDSDSTDXTVRGLGPSYCSFGEMKE

SEQ ID NO: 1587 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWCAGYXYTRDLVYKDPARPKIQKTXTPKELVYETVRVPGCAHHADSLYTYPVATQCHXGKXDSDSTDXTVRGLGPSYCSFGEMKE

SEQ ID NO: 1588 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWXAGYCYTRDLVYKDPARPKIQKTCTPKELVYETVRVPGXAHHADSLYTYPVATQXHCGKCDSDSTDCTVRGLGPSYXSFGEMKE

SEQ ID NO: 1589 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWCAGYXYTRDLVYKDPARPKIQKTCTPKELVYETVRVPGXAHHADSLYTYPVATQCHXGKCDSDSTDCTVRGLGPSYXSFGEMKE

SEQ ID NO: 1590 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWCAGYCYTRDLVYKDPARPKIQKTCTPKELVYETVRVPGXAHHADSLYTYPVATQCHCGKXDSDSTDXTVRGLGPSYXSFGEMKE

SEQ ID NO: 1591 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWXAGYXYTRDLVYKDPARPKIQKTCTPKELVYETVRVPGXAHHADSLYTYPVATQXHXGKCDSDSTDCTVRGLGPSYCSFGEMKE

SEQ ID NO: 1592 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWXAGYCYTRDLVYKDPARPKIQKTCTPKELVYETVRVPGXAHHADSLYTYPVATQXHCGKXDSDSTDXTVRGLGPSYCSFGEMKE

SEQ ID NO: 1593 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWCAGYXYTRDLVYKDPARPKIQKTCTPKELVYETVRVPGXAHHADSLYTYPVATQCHXGKXDSDSTDXTVRGLGPSYCSFGEMKE

SEQ ID NO: 1594 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWXAGYXYTRDLVYKDPARPKIQKTCTPKELVYETVRVPGCAHHADSLYTYPVATQXHXGKCDSDSTDCTVRGLGPSYXSFGEMKE

SEQ ID NO: 1595 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWXAGYCYTRDLVYKDPARPKIQKTCTPKELVYETVRVPGCAHHADSLYTYPVATQXHCGKXDSDSTDXTVRGLGPSYXSFGEMKE

SEQ ID NO: 1596 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWCAGYXYTRDLVYKDPARPKIQKTCTPKELVYETVRVPGCAHHADSLYTYPVATQCHXGKXDSDSTDXTVRGLGPSYXSFGEMKE

SEQ ID NO: 1597 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFCISINTTWXAGYXYTRDLVYKDPARPKIQKTCTPKELVYETVRVPGCAHHADSLYTYPVATQXHXGKXDSDSTDXTVRGLGPSYCSFGEMKE

SEQ ID NO: 1598 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWXAGYCYTRDLVYKDPARPKIQKTXTPKELVYETVRVPGXAHHADSLYTYPVATQXHCGKCDSDSTDCTVRGLGPSYXSFGEMKE

SEQ ID NO: 1599 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWCAGYXYTRDLVYKDPARPKIQKTXTPKELVYETVRVPGXAHHADSLYTYPVATQCHXGKCDSDSTDCTVRGLGPSYXSFGEMKE

SEQ ID NO: 1600 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWCAGYCYTRDLVYKDPARPKIQKTXTPKELVYETVRVPGXAHHADSLYTYPVATQCHCGKXDSDSTDXTVRGLGPSYXSFGEMKE

SEQ ID NO: 1601 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWXAGYXYTRDLVYKDPARPKIQKTXTPKELVYETVRVPGXAHHADSLYTYPVATQXHXGKCDSDSTDCTVRGLGPSYCSFGEMKE

SEQ ID NO: 1602 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWXAGYCYTRDLVYKDPARPKIQKTXTPKELVYETVRVPGXAHHADSLYTYPVATQXHCGKXDSDSTDXTVRGLGPSYCSFGEMKE

SEQ ID NO: 1603 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWCAGYXYTRDLVYKDPARPKIQKTXTPKELVYETVRVPGXAHHADSLYTYPVATQCHXGKXDSDSTDXTVRGLGPSYCSFGEMKE

SEQ ID NO: 1604 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWXAGYXYTRDLVYKDPARPKIQKTXTPKELVYETVRVPGCAHHADSLYTYPVATQXHXGKCDSDSTDCTVRGLGPSYXSFGEMKE

SEQ ID NO: 1605 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWXAGYCYTRDLVYKDPARPKIQKTXTPKELVYETVRVPGCAHHADSLYTYPVATQXHCGKXDSDSTDXTVRGLGPSYXSFGEMKE

SEQ ID NO: 1606 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWCAGYXYTRDLVYKDPARPKIQKTXTPKELVYETVRVPGCAHHADSLYTYPVATQCHXGKXDSDSTDXTVRGLGPSYXSFGEMKE

SEQ ID NO: 1607 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFCISINTTWXAGYXYTRDLVYKDPARPKIQKTXTPKELVYETVRVPGCAHHADSLYTYPVATQXHXGKXDSDSTDXTVRGLGPSYCSFGEMKE

SEQ ID NO: 1608 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWXAGYXYTRDLVYKDPARPKIQKTCTPKELVYETVRVPGXAHHADSLYTYPVATQXHXGKCDSDSTDCTVRGLGPSYXSFGEMKE

SEQ ID NO: 1609 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWXAGYCYTRDLVYKDPARPKIQKTCTPKELVYETVRVPGXAHHADSLYTYPVATQXHCGKXDSDSTDXTVRGLGPSYXSFGEMKE

SEQ ID NO: 1610 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWCAGYXYTRDLVYKDPARPKIQKTCTPKELVYETVRVPGXAHHADSLYTYPVATQCHXGKXDSDSTDXTVRGLGPSYXSFGEMKE

SEQ ID NO: 1611 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFCISINTTWXAGYXYTRDLVYKDPARPKIQKTCTPKELVYETVRVPGXAHHADSLYTYPVATQXHXGKXDSDSTDXTVRGLGPSYCSFGEMKE

SEQ ID NO: 1612 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEECRFXISINTTWXAGYXYTRDLVYKDPARPKIQKTCTPKELVYETVRVPGCAHHADSLYTYPVATQXHXGKXDSDSTDXTVRGLGPSYXSFGEMKE

SEQ ID NO: 1613 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWXAGYXYTRDLVYKDPARPKIQKTXTPKELVYETVRVPGXAHHADSLYTYPVATQXHXGKCDSDSTDCTVRGLGPSYXSFGEMKE

SEQ ID NO: 1614 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWXAGYCYTRDLVYKDPARPKIQKTXTPKELVYETVRVPGXAHHADSLYTYPVATQXHCGKXDSDSTDXTVRGLGPSYXSFGEMKE

SEQ ID NO: 1615 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFXISINTTWCAGYXYTRDLVYKDPARPKIQKTXTPKELVYETVRVPGXAHHADSLYTYPVATQCHXGKXDSDSTDXTVRGLGPSYXSFGEMKE

SEQ ID NO: 1616 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEEXRFCISINTTWXAGYXYTRDLVYKDPARPKIQKTXTPKELVYETVRVPGXAHHADSLYTYPVATQXHXGKXDSDSTDXTVRGLGPSYCSFGEMKE

SEQ ID NO: 1617 - protein, 111 aa, Artificial Sequence
  Synthesized sequence with two or more selenocysteine residues substituted for two or more cysteine residues
  VARIANT (1)...(111): Xaa = selenocysteine or cysteine
NSXELTNITIAIEKEECRFXISINTTWXAGYXYTRDLVYKDPARPKIQKTXTPKELVYETVRVPGCAHHADSLYTYPVATQXHXGKXDSDSTDXTVRGLGPSYXSFGEMKE

SEQ ID NO: 1618 - protein, 111 aa, Artificial Sequence
  Synthesized sequence with two or more selenocysteine residues substituted for two or more cysteine residues
  VARIANT (1)...(111): Xaa = selenocysteine or cysteine
NSCELTNITIAIEKEEXRFXISINTTWXAGYXYTRDLVYKDPARPKIQKTCTPKELVYETVRVPGXAHHADSLYTYPVATQXHXGKXDSDSTDXTVRGLGPSYXSFGEMKE

SEQ ID NO: 1619 - protein, 111 aa, Artificial Sequence; identical to SEQ ID NO: 1200
  Synthesized sequence with two or more selenocysteine residues substituted for two or more cysteine residues
  VARIANT (1)...(111): Xaa = selenocysteine or cysteine

SEQ ID NO: 1620 - protein, 229 aa, Artificial Sequence
  Synthesized sequence with two or more selenocysteine residues substituted for two or more cysteine residues
  VARIANT (1)...(229): Xaa = selenocysteine or cysteine
MFTVTVPKDLYVVEYGSNMTIEXKFPVEKQLDLAALIVYWEMEDKNIIQFVHGEEDLKVQHSSYRQRARLLKDQLSLGNAALQITDVKLQDAGVYRXMISYGGADYKRITVKVNAPYNKINQRILVVDPVTSEHELTXQAEGYPKAEVIWTSSDHQVLSGKTTTTNSKREEKLFNVTSTLRINTTTNEIFYXTFRRLDPEENHTAELVIPELPLAHPPNERGSHHHHHH

SEQ ID NO: 1621 - protein, 461 aa, Artificial Sequence
  Synthesized sequence with two or more selenocysteine residues substituted for two or more cysteine residues
  VARIANT (1)...(461): Xaa = selenocysteine or cysteine
MFTVTVPKDLYVVEYGSNMTIEXKFPVEKQLDLAALIVYWEMEDKNIIQFVHGEEDLKVQHSSYRQRARLLKDQLSLGNAALQITDVKLQDAGVYRXMISYGGADYKRITVKVNAPYNKINQRILVVDPVTSEHELTXQAEGYPKAEVIWTSSDHQVLSGKTTTTNSKREEKLFNVTSTLRINTTTNEIFYXTFRRLDPEENHTAELVIPELPLAHPPNERGGGGSGGGGSGGGGSAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTKPPSRDELTKNQVSLSXLVKGFYPSDIAVEWESNGQPENNYKTTVPVLDSDGSFRLASYLTVDKSRWQQGNVFSXSVMHEALHNHYTQKSLSLSPGKGSHHHHHH

SEQ ID NO: 1622 - protein, 126 aa, Artificial Sequence
  Synthesized sequence with two or more selenocysteine residues substituted for two or more cysteine residues
  VARIANT (1)...(126): Xaa = selenocysteine or cysteine
MAFTVTVPKDLYVVEYGSNMTIEXKFPVEKQLDLAALIVYWEMEDKNIIQFVHGEEDLKVQHSSYRQRARLLKDQLSLGNAALQITDVKLQDAGVYRXMISYGGADYKRITVKVNAPYGSHHHHHH

SEQ ID NO: 1623 - protein, 358 aa, Artificial Sequence
  Synthesized sequence with two or more selenocysteine residues substituted for two or more cysteine residues
  VARIANT (1)...(358): Xaa = selenocysteine or cysteine
MAFTVTVPKDLYVVEYGSNMTIEXKFPVEKQLDLAALIVYWEMEDKNIIQFVHGEEDLKVQHSSYRQRARLLKDQLSLGNAALQITDVKLQDAGVYRXMISYGGADYKRITVKVNAPYGGGGSGGGGSGGGGSAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTKPPSRDELTKNQVSLSXLVKGFYPSDIAVEWESNGQPENNYKTTVPVLDSDGSFRLASYLTVDKSRWQQGNVFSXSVMHEALHNHYTQKSLSLSPGKGSHHHHHH

SEQ ID NO: 1624 - protein, 226 aa, Artificial Sequence
  Synthesized sequence with two or more selenocysteine residues substituted for two or more cysteine residues
  VARIANT (1)...(226): Xaa = selenocysteine or cysteine
MAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTKPPSRDELTKNQVSLSXLVKGFYPSDIAVEWESNGQPENNYKTTVPVLDSDGSFRLASYLTVDKSRWQQGNVFSXSVMHEALHNHYTQKSLSLSPGKGSHHHHHH

SEQ ID NO: 1625 - protein, 116 aa, Artificial Sequence
  Synthesized sequence with two or more selenocysteine residues substituted for two or more cysteine residues
  VARIANT (1)...(116): Xaa = selenocysteine or cysteine
MGQXREPQVYTSPPSRDELTKNQVSLRXHVKGFYPSDIAVEWESNGQPENNYKTTKPVLDSDGSFFLYSKLTVDKSRWQQGNVFSXSVMHEXLHNHYTQKSLSLSPGKGSHHHHHH

SEQ ID NO: 1626 - protein, 322 aa, Artificial Sequence
  Synthesized sequence with two or more selenocysteine residues substituted for two or more cysteine residues
  VARIANT (1)...(322): Xaa = selenocysteine or cysteine
MFPTIPLSRLFDNAMLRAHRLHQLAFDTYQEFEEAYIPKEQKYSFLQNPQTSLXFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYXFRKDMDKVETFLRIVQXRSVEGSXGFGGGGSGGGGSGGGGSGQXREPQVYTSPPSRDELTKNQVSLRXHVKGFYPSDIAVEWESNGQPENNYKTTKPVLDSDGSFFLYSKLTVDKSRWQQGNVFSXSVMHEXLHNHYTQKSLSLSPGKGSHHHHHH

SEQ ID NO: 1627 - protein, 432 aa, Artificial Sequence
  Synthesized sequence with two or more selenocysteine residues substituted for two or more cysteine residues
  VARIANT (1)...(432): Xaa = selenocysteine or cysteine
MFPTIPLSRLFDNAMLRAHRLHQLAFDTYQEFEEAYIPKEQKYSFLQNPQTSLXFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYXFRKDMDKVETFLRIVQXRSVEGSXGFGGGGSGGGGSGGGGSAPELLGGPSVFLFPPKPKDTLMISRTPEVTXVVVDVSHEDPEVKFNWYVDGVEVHNAKTKPREEQYNSTYRVVSVLTVLHQDWLNGKEYKXKVSNKALPAPIEKTISKAKGQPREPQVYTKPPSRDELTKNQVSLSXLVKGFYPSDIAVEWESNGQPENNYKTTVPVLDSDGSFRLASYLTVDKSRWQQGNVFSXSVMHEALHNHYTQKSLSLSPGKGSHHHHHH

SEQ ID NO: 1628 - protein, 200 aa, Artificial Sequence
  Synthesized sequence with two or more selenocysteine residues substituted for two or more cysteine residues
  VARIANT (1)...(200): Xaa = selenocysteine or cysteine
MFPTIPLSRLFDNAMLRAHRLHQLAFDTYQEFEEAYIPKEQKYSFLQNPQTSLXFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYXFRKDMDKVETFLRIVQXRSVEGSXGFGSHHHHHH

SEQ ID NO: 1629 - protein, 255 aa, Artificial Sequence
  Synthesized sequence with two or more selenocysteine residues substituted for two or more cysteine residues
  VARIANT (1)...(255): Xaa = selenocysteine or cysteine
MDIQMTQSPSSLSASVGDRVTITXRASQDVNTAVAWYQQKPGKAPKLLIYSASFLYSGVPSRFSGSRSGTDFTLTISSLQPEDFATYYXQQHYTTPPTFGQGTKVEIKGASGGGGSGGGGSGGGGSSEVQLVESGGGLVQPGGSLRLSXAASGFNIKDTYIHWVRQAPGKGLEWVARIYPTNGYTRYADSVKGRFTISADTSKNTAYLQMNSLRAEDTAVYYXSRWGGDGFYAMDYWGQGTLVTVSSGSHHHHHH

SEQ ID NO: 1630 - protein, 110 aa, Homo sapiens
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 1631 - protein, 252 aa, Artificial sequence
  Synthetic polypeptide
  VARIANT (23)..(23): Xaa = selenocysteine
  VARIANT (97)..(97): Xaa = selenocysteine
  VARIANT (159)..(159): Xaa = selenocysteine
  VARIANT (224)..(224): Xaa = selenocysteine
MEVQLLESGGGLAKPGGSLRLSXAASGFTFTDYYMDWVRQAPGKGLEWVSRISPGGDVTWYADSVKGRFTISRDNAQNTLYLQMNSLRAEDTAVYFXARDDIVVSRIFDDWGQGVLLTVSSGGGGSGGGGSGGGGSELQMTQSPSSLSASVGDRVTITXRASQSIRSYLAWYQQKPGKAPKLLIYDAAHLQSGVPSRFSGSGSGTEFSLTISSLQPEDFAVYYXQQRNSYPLTFGGGTKVEIKRGSHHHHHH

SEQ ID NO: 1632 - protein, 295 aa, Artificial Sequence
  Synthetic polypeptide
  MISC_FEATURE (42)..(42): Xaa is selenocysteine
  misc_feature (116)..(116): Xaa is selenocysteine
  misc_feature (179)..(179): Xaa is selenocysteine
  misc_feature (249)..(249): Xaa is selenocysteine
MHHHHHHLVPRGSGKSAMAAEVKLVESGGGLVKPGGSLKLSXAASGFTFSSYAMSWVRQTPEKRLEWVATISTGGGYTYFPDSVKGRFTISRDNAKNALYLQMKSLRSEDTAMYYXARQGDFGDWYFDVWGAGTTVTVSSGGGGSGGGGSGGGGSTDVLMTQTPLSLPVSLGDQASISXRSSQSLVHSNGNTYLHWYLQKPGQSPKLLIYKVSNRFSGVPDRFSGSGSGTDFTLKISRVEAEDLGVYFXSQSTHVPWTFGGGTKLEIKRAAADYKDHDGDYKDHDIDYKDDDDKC

The invention claimed is:

1. A protein comprising at least two selenocysteine residues with at least one diselenide bond between the at least two selenocysteine residues, wherein the protein comprises a sequence selected from the group consisting of: SEQ ID NO: 1142, 1144, 1146, 1148, 1150, 1152, 1154 and residues 90-110 of SEQ ID NO: 1630 and sequences that are at least 80% identical to said sequence.

2. The protein of claim 1, wherein the protein is a modified insulin protein that further comprises a B chain having a sequence of residues 25-54 of SEQ ID NO: 1630 with at least one cysteine to selenocysteine substitution and sequences that are at least 80% identical to said sequence; wherein the protein comprises at least one diselenide bond within the A chain and at least one diselenide bond between the A chain and the B chain.

3. A bacterial host that has been genomically recoded so that an unassigned codon is recognized by a selenocysteine tRNA with a corresponding anticodon, wherein the bacterial host contains a constructed DNA sequence encoding a variant form of a protein in which a pair of cysteine codons has been replaced with the unassigned codon wherein the variant form comprises a modified insulin protein having at least two selenocysteine residues replacing two cysteine residues that form a disulfide bond in a native human insulin protein, with at least one diselenide bond between the at least two selenocysteine residues.

4. A method of producing a modified insulin protein having at least two selenocysteine residues replacing two cysteine residues that form a disulfide bond in a native human insulin protein, with at least one diselenide bond between the at least two selenocysteine residues, the method comprising:
    culturing a bacterial host that has been genomically recoded so that an unassigned codon is recognized by a selenocysteine tRNA with a corresponding anticodon, wherein the bacterial host contains a constructed DNA sequence encoding the modified protein in which a pair of cysteine codons has been replaced with the unassigned codon, wherein the culturing is under conditions in which the modified protein is expressed.

5. The bacterial host of claim 3, wherein the modified insulin protein has an A chain comprising at least two selenocysteine residues with at least one diselenide bond between the at least two selenocysteine residues, wherein the protein comprises a sequence selected from the group consisting of: SEQ ID NO: 1142, 1144, 1146, 1148, 1150, 1152, 1154 and residues 90-110 of SEQ ID NO: 1630 and sequences that are at least 80% identical to said sequence.

6. The bacterial host of claim 5, wherein the modified insulin protein further comprises a B chain having a sequence of residues 25-54 of SEQ ID NO: 1630 with at least one cysteine to selenocysteine substitution and sequences that are at least 80% identical to said sequence; wherein the protein comprises at least one diselenide bond within the A chain and at least one diselenide bond between the A chain and the B chain.

7. The bacterial host of claim 3, wherein the modified insulin protein comprises an A chain having a sequence of residues 90-110 of SEQ ID NO: 1630 with at least one cysteine to selenocysteine substitution and sequences that are at least 80% identical to said sequence, and a B chain having a sequence of residues 25-54 of SEQ ID NO: 1630 with at least one cysteine to selenocysteine substitution and sequences that are at least 80% identical to said sequence; wherein the protein comprises at least one diselenide bond between the A chain and the B chain.

8. The method of claim 4, wherein the modified insulin protein has an A chain comprising at least two selenocysteine residues with at least one diselenide bond between the at least two selenocysteine residues, wherein the protein comprises a sequence selected from the group consisting of: SEQ ID NO: 1142, 1144, 1146, 1148, 1150, 1152, 1154 and residues 90-110 of SEQ ID NO: 1630 and sequences that are at least 80% identical to said sequence.

9. The method of claim 8, wherein the modified insulin protein further comprises a B chain having a sequence of residues 25-54 of SEQ ID NO: 1630 with at least one cysteine to selenocysteine substitution and sequences that are at least 80% identical to said sequence; wherein the protein comprises at least one diselenide bond within the A chain and at least one diselenide bond between the A chain and the B chain.

10. The method of claim 4, wherein the modified insulin protein comprises an A chain having a sequence of residues 90-110 of SEQ ID NO: 1630 with at least one cysteine to selenocysteine substitution and sequences that are at least 80% identical to said sequence, and a B chain having a sequence of residues 25-54 of SEQ ID NO: 1630 with at least one cysteine to selenocysteine substitution and sequences that are at least 80% identical to said sequence; wherein the protein comprises at least one diselenide bond between the A chain and the B chain.

* * * * *